(12) United States Patent
Chappell et al.

(10) Patent No.: US 11,254,712 B2
(45) Date of Patent: Feb. 22, 2022

(54) CHIMERIC MOLECULES AND USES THEREOF

(71) Applicant: The University of Queensland, St Lucia (AU)

(72) Inventors: Keith Joseph Chappell, St Lucia (AU); Daniel Watterson, St Lucia (AU); Paul Robert Young, St Lucia (AU)

(73) Assignee: The University of Queensland, St. Lucia (AU)

( * ) Notice: Subject to any disclaimer, the term of this patent is extended or adjusted under 35 U.S.C. 154(b) by 0 days.

(21) Appl. No.: 16/498,865

(22) PCT Filed: Mar. 29, 2018

(86) PCT No.: PCT/AU2018/050299
§ 371 (c)(1),
(2) Date: Sep. 27, 2019

(87) PCT Pub. No.: WO2018/176103
PCT Pub. Date: Oct. 4, 2018

(65) Prior Publication Data
US 2020/0040042 A1 Feb. 6, 2020

(30) Foreign Application Priority Data

Mar. 30, 2017 (AU) .............................. 2017901152

(51) Int. Cl.
*A61K 39/00* (2006.01)
*C07K 14/16* (2006.01)
(Continued)

(52) U.S. Cl.
CPC .............. *C07K 14/16* (2013.01); *C07K 19/00* (2013.01); *C12N 15/1034* (2013.01);
(Continued)

(58) Field of Classification Search
None
See application file for complete search history.

(56) References Cited

U.S. PATENT DOCUMENTS

2003/0220476 A1* 11/2003 Koh ..................... C07K 14/515
530/350
2010/0239617 A1* 9/2010 Pushko ................... A61P 31/12
424/400

FOREIGN PATENT DOCUMENTS

WO   WO 2001/004335        1/2001
WO   WO-2011034605 A2 *   3/2011 ............. C07K 16/32
(Continued)

OTHER PUBLICATIONS

Hsu et al., "Progress in HIV vaccine development," Human Vaccines & Immunotherapeutics, vol. 13, No. 5: 1018-1030 (Year: 2017).*

(Continued)

*Primary Examiner* — M Franco G Salvoza
(74) *Attorney, Agent, or Firm* — Parker Highlander PLLC

(57) ABSTRACT

Disclosed are chimeric polypeptides based on viral membrane fusion proteins. More particularly, the present invention discloses chimeric polypeptides that comprise a virion surface exposed portion of a viral fusion protein and a heterologous structure-stabilizing moiety, and to complexes of those chimeric polypeptides. The present invention also discloses the use of these complexes in comp

(51) Int. Cl.
    *C07K 19/00* (2006.01)
    *C12N 15/10* (2006.01)
(52) U.S. Cl.
    CPC ...... *C07K 2317/55* (2013.01); *C07K 2319/35* (2013.01); *C12N 2740/16122* (2013.01); *C12N 2740/16134* (2013.01); *C12N 2760/10022* (2013.01); *C12N 2760/10034* (2013.01); *C12N 2760/14022* (2013.01); *C12N 2760/14034* (2013.01); *C12N 2760/16122* (2013.01); *C12N 2760/16134* (2013.01); *C12N 2760/18022* (2013.01); *C12N 2760/18034* (2013.01); *C12N 2770/20022* (2013.01); *C12N 2770/20034* (2013.01)

(56) References Cited

FOREIGN PATENT DOCUMENTS

| WO | WO 2014/079842 | 5/2014 |
| WO | WO 2014/140083 | 9/2014 |
| WO | WO 2015/177312 | 11/2015 |
| WO | WO 2018/027252 | 2/2018 |

OTHER PUBLICATIONS

Shehata et al., "Middle East respiratory syndrome coronavirus: a comprehensive review," Front. Med. 10(2): 120-136 (Year: 2016).*

Rudikoff et al., "Single amino acid substitution altering antigen-binding specificity," Proc Natl Acad Sci USA 79:1979-1983 (Year: 1982).*
Goel et al., "Plasticity within the Antigen-Combining Site May Manifest as Molecular Mimicry in the Humoral Immune Response," J. Immunol. 173: 7358-7367 (Year: 2004).*
Lloyd et al., "Modelling the human immune response: performance of a 1011 human antibody repertoire against a broad panel of therapeutically relevant antigens," Protein Engineering, Design & Selection, vol. 22, No. 3: 159-168 (Year: 2009).*
Edwards et al., "The Remarkable Flexibility of the Human Antibody Repertoire; Isolation of Over One Thousand Different Antibodies to a Single Protein, BLyS," J. Mol. Biol. 334: 103-118 (Year: 2003).*
Doyle et al., "Two domains that control prefusion stability and transport competence of the measles virus fusion protein," *Journal of Virology*, 80(3):1524-1536, 2006.
Du et al., "A critical HA1 neutralizing domain of H5N1 influenza in an optimal conformation induces strong cross-protection," *PLoS One*, 8(1):e53568, 2013.
Stewart-Jones et al., "A Cysteine Zipper Stabilizes a Pre-Fusion F Glycoprotein Vaccine for Respiratory Syncytial Virus," *PLoS One*, 10(6):e0128779, 2015.
PCT International Preliminary Report on Patentability issued in International Application No. PCT/AU2018/050299, dated Oct. 1, 2019.
PCT International Search Report issued in International Application No. PCT/AU2018/050299, dated May 25, 2018.
Schmidt et al., "Modification of the Respiratory Syncytial Virus F Protein in Virus-Like Particles Impacts Generation of B Cell Memory," *Journal of Virology*, 88(17):10165-10176, 2014.

* cited by examiner

Size Exclusion Chromatography

FIGURE 3

H3N2 neutralisation

CHIMERIC MOLECULES AND USES THEREOF

FIELD OF THE INVENTION

This application is a national phase application under 35 U.S.C. § 371 of International Application No. PCT/AU2018/050299, filed Mar. 29, 2018, which claims priority to Australian Provisional Application No. 2017901152 entitled "Chimeric molecules and uses thereof" filed 30 Mar. 2017, the contents of each of which are incorporated herein by reference in their entirety.

This invention relates generally to chimeric polypeptides based on viral membrane fusion proteins. More particularly, the present invention relates to chimeric polypeptides that comprise a virion surface exposed portion of a viral fusion protein and a heterologous structure-stabilizing moiety, and to complexes of those chimeric polypeptides. The present invention also relates to the use of these complexes in compositions and methods for eliciting an immune response to a fusion protein of an enveloped virus, or complex of the fusion protein, and/or for treating or preventing an enveloped virus infection. The present invention further relates to the use of the heterologous structure-stabilizing moiety for oligomerizing heterologous molecules of interest.

BACKGROUND OF THE INVENTION

Enveloped viruses, such as human immunodeficiency virus (HIV), influenza virus and respiratory syncytial virus (RSV), require fusion of viral membrane with the a host cell's membrane to enter and infect the host cell. Viral fusion proteins facilitate this process by undergoing energy favorable structural rearrangements from a metastable 'pre-fusion' conformation to a highly stable 'post-fusion' conformation. This structural change drives fusion of the virus and host cell membranes resulting in the release of viral genome into the cell.

Viral fusion proteins are currently classified into three classes based on their individual structural architecture and molecular features that drive the fusion process. Both class I and class III fusion proteins are trimeric in both their pre- and post-fusion conformations, while class II fusion proteins are dimeric in their pre-fusion conformation which is then rearranged into a trimeric post-fusion form. It is possible however that new classes of viral fusion proteins may be identified in the future that share some key features in common with these currently defined classes. Class I and class III fusion proteins share substantial structural features, including the N-terminal signal sequence and C-terminal transmembrane and cytoplasmic domain. They also share similar fusion mechanisms, with the initial pre-fusion trimer undergoing partial dissociation to allow the significant structural rearrangement required to form the post-fusion trimer.

Viral fusion proteins are excellent subunit vaccine candidates, as they are the primary targets of protective neutralizing antibody responses for many medically important enveloped viruses. The intrinsic metastable nature of fusion proteins, however, is a major obstacle for effective subunit vaccine design, as recent evidence has shown that broadly cross-reactive and potently neutralizing antibodies elicited during natural infection react primarily with the pre- and not post-fusion forms. In addition, the pre-fusion form of viral envelope fusion proteins contains epitopes that are not present on the post-fusion form (e.g., Magro et al., 2012. Proc. Natl. Acad. Sci. USA 109(8):3089-3094). Thus, for vaccines, the stabilized pre-fusion form is generally considered more desirable antigenically. However, traditional approaches to recombinant expression of these proteins typically results in premature triggering and a conformational shift to the structurally more stable post-fusion form.

Consequently, there is a pressing need for new approaches to produce stabilized recombinant fusion proteins that remain substantially in their pre-fusion form to stimulate more efficacious immune responses against enveloped viruses.

SUMMARY OF THE INVENTION

The present invention arises from the determination that a pre-fusion conformation of a viral fusion protein can be mimicked by operably connecting downstream of the fusion protein virion surface exposed domain (also referred to herein as a "fusion ectodomain polypeptide" or "ectodomain") a heterologous moiety that comprises a pair of complementary heptad repeat regions that associate with one another to form an anti-parallel, two-helix bundle. This moiety acts as a kind of 'molecular clamp' that stabilizes the fusion ectodomain polypeptide, and inhibiting it from rearranging to a post-fusion conformation. The molecular clamp approach of the present invention has been used to produce chimeric polypeptides that mimic the pre-fusion conformations of influenza, RSV, HIV, measles virus and Ebola virus, respectively, and thus lends itself as a platform for producing mimetics of viral envelope fusion proteins in a pre-fusion conformation. The chimeric polypeptides so produced can self-assemble to form an artificial enveloped virus fusion protein complex that comprises an oligomer of the chimeric polypeptide and that mimics the pre-fusion conformation of a native enveloped virus fusion protein complex. This self-assembly permits facile production of the artificial complexes inter alia in recombinant expression systems. The artificial complexes produced using the chimeric polypeptides of the invention are useful in methods and compositions for stimulating an immune response, including the development of neutralizing antibodies, to the native enveloped virus fusion protein complex, as described hereafter.

Accordingly, the present invention provides, in one aspect, a chimeric polypeptide comprising an enveloped virus fusion ectodomain polypeptide operably connected downstream to a heterologous, structure-stabilizing moiety comprising complementary first heptad repeat (HR1) and second heptad repeat (HR2) regions that associate with each other under conditions suitable for their association (e.g., in aqueous solution) to form an anti-parallel, two-helix bundle. The HR1 and HR2 regions typically lack complementarity to the ectodomain polypeptide, so that they preferentially form an anti-parallel, two-helix bundle with each other, rather than with structural elements of the ectodomain polypeptide. In some embodiments, each of the HR1 and HR2 regions is independently characterized by a n-times repeated 7-residue pattern of amino acid types, represented as $(a\text{-}b\text{-}c\text{-}d\text{-}e\text{-}f\text{-}g\text{-})_n$ or $(d\text{-}e\text{-}f\text{-}g\text{-}a\text{-}b\text{-}c\text{-})_n$, wherein the pattern elements 'a' to 'g' denote conventional heptad positions at which the amino acid types are located and n is a number equal to or greater than 2, and at least 50% (or at least 51% to at least 99% and all integer percentages in between) of the conventional heptad positions 'a' and 'd' are occupied by hydrophobic amino acid types and at least 50% (or at least 51% to at least 99% and all integer percentages in between) of the conventional heptad positions 'b', 'c', 'e', 'f' and 'g' are occupied by hydrophilic amino acid types, the resulting distribution between hydrophobic and hydrophilic amino acid types enabling the identification of the heptad repeat regions. In some embodiments, one or both of the HR1 and HR2 regions comprises, consists or consists essentially of an endogenous Class I enveloped virus fusion protein heptad repeat region amino acid sequence. In representative examples of this type, the HR1 and HR2 regions comprise, consist or consist essentially of complementary endogenous heptad repeat A (HRA) and heptad repeat B (HRB) regions, respectively, of one or more Class I enveloped virus fusion proteins. In some embodiments, the HRA region amino acid sequence and the HRB region amino acid sequence are derived from the same Class I enveloped virus fusion protein. In other embodiments, the HRA region amino acid sequence and the HRB region amino acid sequence are derived from the different Class I enveloped virus fusion proteins. In representative examples, the HR1 and HR2 regions are independently selected from HRA and HRB regions of fusion proteins expressed by orthomyxoviruses, paramyxoviruses, retroviruses, coronaviruses, filoviruses and arenaviruses.

In some embodiments, the ectodomain polypeptide corresponds to a Class I enveloped virus fusion protein ectodomain. In representative examples of this type, the ectodomain polypeptide comprises one or both of an endogenous HRA region and an endogenous HRB region. Non-limiting enveloped viruses with Class I fusion proteins include orthomyxoviruses, paramyxoviruses, retroviruses, coronaviruses, filoviruses and arenaviruses.

In other embodiments, the ectodomain polypeptide corresponds to a Class III enveloped virus fusion protein ectodomain. Representative enveloped viruses with Class III fusion proteins include rhabdoviruses and herpesviruses.

The ectodomain polypeptide (e.g., Class I or Class III) may comprise or consist of a whole precursor ectodomain polypeptide or a portion thereof. In some embodiments the ectodomain polypeptide lacks any one or more of an endogenous signal peptide, an endogenous head portion of an ectodomain, an endogenous stem portion of an ectodomain, an endogenous mucin-like domain, an endogenous membrane proximal external region and an endogenous fusion peptide. The ectodomain polypeptide suitably comprises at least one pre-fusion epitope that is not present in the post-fusion form of an enveloped virus fusion protein to which the ectodomain polypeptide corresponds.

In some embodiments, the HR1 and HR2 regions of the structure-stabilizing moiety are connected by a linker, which generally consists of about 1 to about 100 amino acid residues (and all integer amino acid residues therebetween), and typically of about 1 to about 100 amino acid residues (and all integer amino acid residues therebetween). The linker may comprise at least one moiety selected from a purification moiety that facilitates purification of the chimeric polypeptide, an immune-modulating moiety that modulates an immune response to the chimeric polypeptide, a cell targeting moiety that directs the chimeric polypeptide to a specific cell subtype and a structural flexibility-conferring moiety.

The chimeric polypeptide can be produced synthetically or by recombinant means. In embodiments in which the chimeric polypeptide is produced recombinantly, the present invention provides in another aspect a nucleic acid construct that comprises a coding sequence for a chimeric polypeptide as broadly described above and elsewhere herein, operably linked to a regulatory element that is operable in the host cell.

In a related aspect, the present invention provides a host cell that contains the nucleic acid construct broadly described above and elsewhere herein. The host cell may be a prokaryotic or eukaryotic host cell.

In addition to its utility in stabilizing the ectodomain polypeptide against rearrangement to a post-fusion conformation, the heterologous structure-stabilizing moiety is useful for oligomerizing any heterologous molecules of interest into oligomers, particularly trimers. Accordingly, in another aspect, the present invention provides a chimeric polypeptide comprising a proteinaceous molecule operably connected downstream to a heterologous, structure-stabilizing moiety comprising complementary first heptad repeat (HR1) and second heptad repeat (HR2) regions that associate with each other under conditions suitable for their association (e.g., in aqueous solution) to form an anti-parallel, two-helix bundle, as broadly described above and elsewhere herein.

The chimeric polypeptides of the present invention can self-assemble under suitable conditions (e.g., in aqueous solution) to form a chimeric polypeptide complex. Accordingly, in another aspect, the present invention provides a method of producing a chimeric polypeptide complex, wherein the method comprises: combining chimeric polypeptides as broadly defined above and elsewhere herein under conditions (e.g., in aqueous solution) suitable for the formation of a chimeric polypeptide complex, whereby a chimeric polypeptide complex is produced that comprises three chimeric polypeptides and is characterized by a six-helix bundle formed by oligomerization of the two-helix bundles of the respective structure-stabilizing moieties of the chimeric polypeptides.

In a related aspect, the present invention provides a chimeric polypeptide complex that comprises three chimeric polypeptides as broadly described above and elsewhere herein and is characterized by a six-helix bundle formed by oligomerization of the two-helix bundles of the respective structure-stabilizing moieties of the chimeric polypeptides. In some embodiments in which the chimeric polypeptide comprises an enveloped virus fusion ectodomain polypeptide, the chimeric polypeptide complex formed by self-assembly of the chimeric polypeptide comprises at least one pre-fusion epitope of an enveloped virus fusion protein of interest (e.g., a wild-type enveloped virus fusion protein), or complex thereof, which is not present on a post-fusion form of the enveloped virus fusion protein, or complex thereof.

The present invention in another related aspect provides a composition comprising a chimeric polypeptide or chimeric polypeptide complex as broadly described above and elsewhere herein, and a pharmaceutically acceptable carrier, diluent or adjuvant. In some embodiments, the composition is an immune-modulating composition.

In some embodiments in which the chimeric polypeptide comprises an enveloped virus fusion ectodomain polypeptide, the chimeric polypeptide complex of the present invention is useful for eliciting an immune response in subjects or production animals, to a fusion protein of an enveloped virus, or complex of the fusion protein. Accordingly, another aspect of the present invention provides a method of eliciting an immune response to a fusion protein of an enveloped virus, or complex of the fusion protein, in a subject, wherein the method comprises administering to the subject a chimeric polypeptide complex or composition, as broadly described above and elsewhere herein, wherein an ectodomain polypeptide of the chimeric polypeptide complex corresponds to the fusion protein of the enveloped virus.

In a related aspect, the present invention provides a method of identifying an agent (e.g., a small molecule or macromolecule) that binds with a fusion protein of an enveloped virus, or complex of the fusion protein, wherein the method comprises: contacting the candidate agent with an ectodomain polypeptide-containing chimeric polypeptide or chimeric polypeptide complex, as broadly described above and elsewhere herein, wherein the ectodomain polypeptide corresponds to the fusion protein of the enveloped virus, and detecting binding of the candidate agent to the chimeric polypeptide or chimeric polypeptide complex. In specific embodiments, the method further comprises contacting the candidate agent with the fusion protein or complex of the fusion protein and detecting binding of the candidate agent to the fusion protein or the complex. In specific embodiments, the candidate agent is part of a compound library (e.g., small molecule or macromolecule library). In some of these embodiments, the method further comprises isolating the candidate agent from the library. Suitably, the candidate agent binds specifically to the chimeric polypeptide or chimeric polypeptide complex, and preferably to the fusion protein or complex of the fusion protein.

In another related aspect, the present invention provides a method of producing an antigen-binding molecule (e.g., an antibody such as a neutralizing antibody) that is immuno-interactive with a fusion protein of an enveloped virus, or complex of the fusion protein, wherein the method comprises: (1) immunizing an animal with an ectodomain polypeptide-containing chimeric polypeptide or chimeric polypeptide complex, or composition as broadly described above and elsewhere herein, wherein the ectodomain polypeptide corresponds to the fusion protein of the enveloped virus; (2) identifying and/or isolating a B cell from the animal, which is immuno-interactive with the fusion protein or complex thereof; and (3) producing the antigen-binding molecule expressed by that B cell.

Also provided as a further aspect of the invention is an antigen-binding molecule produced by the immunizing methods broadly described above and elsewhere herein, or a derivative antigen-binding molecule with the same epitope-binding specificity as the antigen-binding molecule. The derivative antigen-binding molecule may be selected from antibody fragments (such as Fab, Fab', F(ab')$_2$, Fv), single chain (scFv) and domain antibodies (including, for example, shark and camelid antibodies), and fusion proteins comprising an antibody, and any other modified configuration of the immunoglobulin molecule that comprises an antigen binding/recognition site.

In a related aspect, the present invention provides an immune-modulating composition comprising an antigen-binding molecule as broadly described above and elsewhere herein, and a pharmaceutically acceptable carrier, diluent or adjuvant.

The subject enveloped virus fusion ectodomain polypeptide-containing chimeric polypeptide or complex thereof, as well as the composition and antigen-binding molecule, as broadly described above and elsewhere herein, are also useful for treating or preventing enveloped virus infections. Accordingly, in yet another aspect, the present invention provides a method for treating or preventing an enveloped virus infection in a subject, wherein the method comprises administering to the subject an effective amount of an enveloped virus fusion ectodomain polypeptide-containing chimeric polypeptide, or complex thereof, composition or antigen-binding molecule, as broadly described above and elsewhere herein.

BRIEF DESCRIPTION OF THE DRAWINGS

FIG. 3 is a graphical representation showing size-exclusion chromatography separation of protein oligomeric state. Chimeric clamp stabilized influenza HA exists as a soluble trimer as seen via it's elution from a Superdex 200 Increase 10/300 GL column at approximately 11 mL. In comparison, the corresponding HA ectodomain expressed in isolation elutes from the column at approximately 8 mL and 12 mL consistent with a portion of the protein existing as aggregates and another portion as monomers. It has previously been shown that the post-fusion form of Influenza HA can dissociate into a monomeric form or aggregate via the exposure of the fusion peptide (Weldon et al., *PLoS One* 2010. 5(9)). Commercial QIV eluted at 8 mL indicating high molecular weight aggregates.

FIG. 4 is a graphical representation showing neutralizing immune response produced upon vaccination. Sera from mice vaccinated with commercial (QIV) vaccine showed neutralization against Influenza A/Hebei Baoding Anguo/51/2010 (H3N2) with an approximate IC50 value of 180. In comparison chimeric clamp stabilized Influenza HA showed a greatly increased level of virus neutralizing activity with an IC50 value of 1:14,000 (95% CI 11,000-17,000), while sera from mice vaccinated with the corresponding HA ectodomain showed no neutralizing activity even at the highest dose tested of 1:20. Pre-incubation with H3sol, QIV did not affect H3N2 neutralization however pre-incubation with H3clamp removed H3N2 neutralization.

FIG. 7 is a graphical representation showing subdomain responsible for H5 cross-reactivity. ELISA was used to measure reactivity with H5. Endpoint titres were calculated as the maximum dilution producing greater than background+3 standard deviations reactivity. Total H5 reactivity for mouse sera is shown (grey bars). Pre-incubation of sera with H3stem, was used to pre-absorb stem specific antibodies prior to ELISA (white bars) or monoclonal antibody FI6v3 was added to outcompete stem specific antibodies (black bars).

FIG. 9 is a graphical representation showing the purification of a clamp stabilized Ebola GP protein lacking the mucin-like domain from CHO supernatant. SDS-PAGE analysis without DTT shows a protein band at approximately 100 kDA which is at the correct size for the resulting Ebola GP protein (GP1 and GP2 linked by the native disulfide bridge) including associated glycans. SDS-PAGE analysis with DTT shows two protein bands at approximately 60kDA and 30 kDa which are the correct sizes for the Furin cleaved Ebola GP protein including associated glycans.

FIG. 10 is a graphical representation showing ELISA Ebola GP clamp (lacking the mucin-like domain) reactivity with highly neutralizing monoclonal antibodies. Monoclonal antibodies Kz52, 1H3, 2G4, 4G7 and 13C6 (Murin et al., PNAS. 2014 11(48):17182-7) all bind with high affinities to Ebola GP clamp (lacking the mucin-like domain).

FIG. 13 is a graphical representation illustrating the ability of the immune response to Ebola GP clamp (lacking the mucin-like domain) following immunization of BALB/C mice to neutralize live Ebola virus, Zaire strain. Sera from mice immunized with 1 µg of Ebola GP clamp (lacking the mucin-like domain)+3 µg of Saponin adjuvant Quil A was capable of neutralizing live Ebola virus. The geometric mean titre producing 50% reduction in plaque forming units was calculated to be 52.8 (95% CI 24.5-114.0).

FIG. 14 is a graphical representation showing immunosilencing of the clamp domain through the incorporation of N-linked glycosylation sites. Four separate mutations within the HRB of the clamp sequence based on the HIV GP160-based SSM were produced in the Ebola GP clamp (lacking the mucin-like domain). The reactivity of sera from mice immunized with the chimeric clamp stabilized influenza HA was tested against Ebola GP clamp (lacking the mucin-like domain) that was either stabilized with the identical clamp sequence or clamp sequences incorporating glycosylations at one of four potential sites. Reactivity was significantly reduced by glycosylation at each individual site supporting the hypothesis that this method can be used to reduce reactivity to the clamp domain. Correct folding of Ebola GP (lacking the mucin-like domain) incorporating mutated clamp sequences was confirmed by measuring Kz52 affinity.

FIG. 15 is a photographic representation showing SDS-PAGE of purified clamp stabilized antigens from eight viruses. Bands designated by orange arrows indicate non-cleaved products and yellow arrows indicated cleaved products. The expected molecular weight of antigens are: Influenza HAclamp=~85 kDa, RSV Fclamp=~65 kDa, Ebola GPclamp=~72 kDa, Nipah Fclamp ~64, MERS Sclamp ~200kDA, Lassa GPCclamp=~75kDA, Measles=~65 kDa and HSV2-Gbclamp=~100 kDa.

FIG. 16 is a graphical representation showing the results of a mouse protection study following challenge with influenza virus H1N1pdm: (A/B) Mice (n=5) were vaccinated with either H1sol, H1foldon or H1 clamp derived from strain Cal/09 (H1N1pdm) and then challenged with the matched influenza strain. (C/D) Mice were vaccinated with either H3sol, H3foldon or H3clamp derived from strain Switz/13 (H3N2) and then challenged with divergent strain Cal/09 (H1N1pdm).

FIG. 19 is a graphical and photographic representation showing that inclusion of the molecular clamp facilitates stabilization of the trimeric pre-fusion conformation. Clamp-stabilized Nipah virus fusion glycoprotein was analyzed by size exclusion chromatography. Elution volume on the superdex 200 column correlates with the expected molecular weight of the soluble trimeric protein. Negative stain electron microscopy (inset) confirms the presence of homogenous, pre-fusion protein conformation.

FIG. 20 is a graphical representation showing immune response to clamp-stabilized subunit vaccines. Sera from mice immunized with Nipah Fclamp were tested for their ability to neutralize Nipah virus. In all panels, values shown are geometric mean of individual mice with error bars indicating geometric standard deviation.

DETAILED DESCRIPTION OF THE INVENTION

1. Definitions

Figure 1:
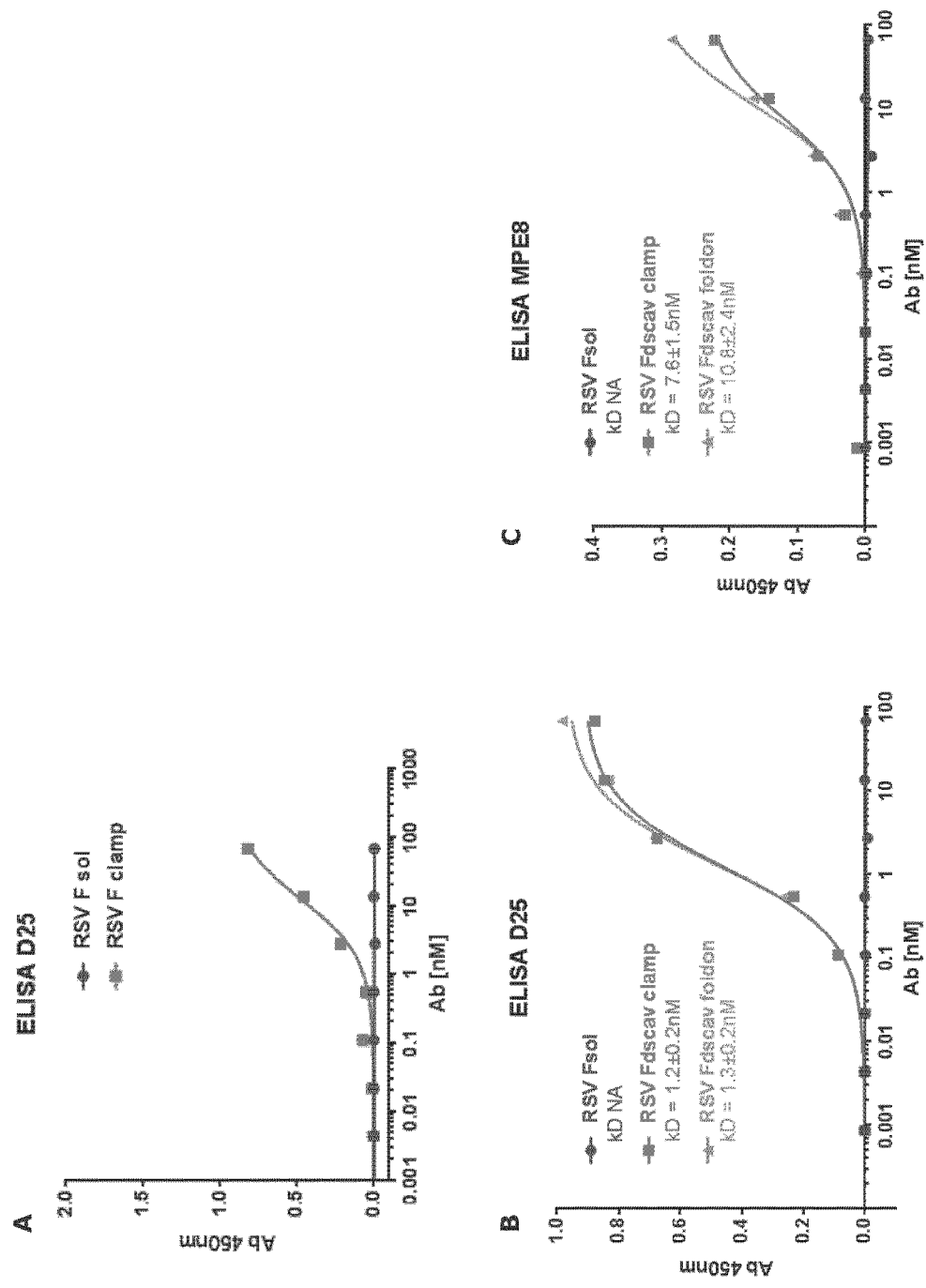
FIG. 1 is a graphical representation showing ELISA RSV F reactivity with conformation specific monoclonal antibody. A. Prefusion specific monoclonal antibody D25 (Zhao et al., *Proc. Natl. Acad. Sci. USA* 2000. 97(26): 14172-7) binds to chimeric clamp stabilized RSV F with an affinity of 23.4±12.5 nM but does not bind to the corresponding unstabilized F ectodomain, F sol. B. Prefusion specific monoclonal antibody D25 binds to chimeric clamp stabilized RSV F DS cav mutant and the control chimeric foldon stabilized RSV F with comparable affinities (1.2±0.2 nM and 1.3±0.2 nM, respectively), but does not bind to the corresponding unstabilized F ectodomain, F sol. C. Broadly cross-neutralizing, prefusion specific monoclonal antibody MPE8 (Corti et al., *Nature* 2013. 501(7467):439-43) binds to chimeric clamp stabilized RSV F DS cav mutant and the control chimeric foldon stabilized RSV F with comparable affinities (7.6±1.5 nM and 10.8±2.4 nM, respectively), but does not bind to the corresponding unstabilized F ectodomain, F sol.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e., to at least one) of the grammatical object of the article. By way of example, "an element" means one element or more than one element.

As used herein, "and/or" refers to and encompasses any and all possible combinations of one or more of the associated listed items, as well as the lack of combinations when interpreted in the alternative (or).

Further, the terms "about" and "approximate", as used herein when referring to a measurable value such as an amount, dose, time, temperature, activity, level, number, frequency, percentage, dimension, size, amount, weight, position, length and the like, is meant to encompass variations of ±15%, ±10%, ±5%, ±1%, ±0.5%, or even ±0.1% of the specified amount, dose, time, temperature, activity, level, number, frequency, percentage, dimension, size, amount, weight, position, length and the like. In instances in which the terms "about" and "approximate" are used in connection with the location or position of regions within a reference polypeptide, these terms encompass variations of ±up to 20 amino acid residues, ±up to 15 amino acid residues, ±up to 10 amino acid residues, ±up to 5 amino acid residues, ±up to 4 amino acid residues, ±up to 3 amino acid residues, ±up to 2 amino acid residues, or even ±1 amino acid residue.

The term "adjuvant" as used herein refers to a compound that, when used in combination with a specific immunogen (e.g., a chimeric polypeptide or complex of the present invention) in a composition, will augment the resultant immune response, including intensification or broadening the specificity of either or both antibody and cellular immune responses.

The term "agent" is used interchangeably with "compound" herein to refer to any compound or substance such as, but not limited to, a small molecule, nucleic acid, polypeptide, peptide, drug, ion, etc. An "agent" can be any chemical, entity or moiety, including without limitation synthetic and naturally-occurring proteinaceous and non-proteinaceous entities. In some embodiments, an agent is nucleic acid, nucleic acid analogues, proteins, antibodies, peptides, aptamers, oligomer of nucleic acids, amino acids, or carbohydrates including without limitation proteins, oligonucleotides, ribozymes, DNAzymes, glycoproteins, siRNAs, lipoproteins, aptamers, and modifications and combinations thereof etc. In some embodiments, the nucleic acid is DNA or RNA, and nucleic acid analogues, for example can be PNA, pcPNA and LNA. A nucleic acid may be single or double stranded, and can be selected from a group comprising; nucleic acid encoding a protein of interest, oligonucleotides, PNA, etc. Such nucleic acid sequences include, for example, but not limited to, nucleic acid sequence encoding proteins that act as transcriptional repressors, antisense molecules, ribozymes, small inhibitory nucleic acid sequences, for example but not limited to RNAi, shRNAi, siRNA, micro RNAi (mRNAi), antisense oligonucleotides etc. A protein and/or peptide agent or fragment thereof, can be any protein of interest, for example, but not limited to; mutated proteins; therapeutic proteins; truncated proteins, wherein the protein is normally absent or expressed at lower levels in the cell. Proteins of interest can be selected from a group comprising; mutated proteins, genetically engineered proteins, peptides, synthetic peptides, recombinant proteins, chimeric proteins, antibodies, humanized proteins, humanized antibodies, chimeric antibodies, modified proteins and fragments thereof.

As used herein, the term "antigen" and its grammatically equivalents expressions (e.g., "antigenic") refer to a compound, composition, or substance that may be specifically bound by the products of specific humoral or cellular immunity, such as an antibody molecule or T-cell receptor. Antigens can be any type of molecule including, for example, haptens, simple intermediary metabolites, sugars (e.g., oligosaccharides), lipids, and hormones as well as macromolecules such as complex carbohydrates (e.g., polysaccharides), phospholipids, and proteins. Common categories of antigens include, but are not limited to, viral antigens, bacterial antigens, fungal antigens, protozoa and other parasitic antigens, tumor antigens, antigens involved in autoimmune disease, allergy and graft rejection, toxins, and other miscellaneous antigens.

By "antigen-binding molecule" is meant a molecule that has binding affinity for a target antigen. It will be understood that this term extends to immunoglobulins, immunoglobulin fragments and non-immunoglobulin derived protein frameworks that exhibit antigen-binding activity. Representative antigen-binding molecules that are useful in the practice of the present invention include polyclonal and monoclonal antibodies as well as their fragments (such as Fab, Fab', F(ab')$_2$, Fv), single chain (scFv) and domain antibodies (including, for example, shark and camelid antibodies), and fusion proteins comprising an antibody, and any other modified configuration of the immunoglobulin molecule that comprises an antigen binding/recognition site. An antibody includes an antibody of any class, such as IgG, IgA, or IgM (or sub-class thereof), and the antibody need not be of any particular class. Depending on the antibody amino acid sequence of the constant region of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant regions that correspond to the different classes of immunoglobulins are called α, δ, ε, γ, and μ, respectively. The subunit structures and three-dimensional configurations of different classes of immunoglobulins are well known. Antigen-binding molecules also encompass dimeric antibodies, as well as multivalent forms of antibodies. In some embodiments, the antigen-binding molecules are chimeric antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see, for example, U.S. Pat. No. 4,816,567; and Morrison et al., 1984, *Proc. Natl. Acad. Sc. USA* 81:6851-6855). Also contemplated, are humanized antibodies, which are generally produced by transferring complementarity determining regions (CDRs) from heavy and light variable chains of a non-human (e.g., rodent, preferably mouse) immunoglobulin into a human variable domain. Typical residues of human antibodies are then substituted in the framework regions of the non-human counterparts. The use of antibody components derived from humanized antibodies obviates potential problems associated with the immunogenicity of non-human constant regions. General techniques for cloning non-human, particularly murine, immunoglobulin variable domains are described, for example, by Orlandi et al., (1989, Proc. Natl. Acad. Sci. USA 86: 3833). Techniques for producing humanized monoclonal antibodies are described, for example, by Jones et al. (1986, *Nature* 321: 522), Carter et al. (1992, *Proc. Natl. Acad. Sci. USA* 89: 4285), Sandhu (1992, *Crit. Rev. Biotech.* 12: 437), Singer et al. (1993, *J. Immun.* 150: 2844), Sudhir (ed., Antibody Engineering Protocols, Humana Press, Inc. 1995), Kelley ("Engineering Therapeutic Antibodies," in Protein Engineering: Principles and Practice Cleland et al. (eds.), pages 399-434 (John Wiley & Sons, Inc. 1996), and by Queen et al., U.S. Pat. No. 5,693,762 (1997). Humanized antibodies include "primatized" antibodies in which the antigen-binding region of the antibody is derived from an antibody produced by immunizing macaque monkeys with the antigen of interest. Also contemplated as antigen-binding molecules are humanized antibodies.

The term "anti-parallel", as used herein, refers to a proteinaceous polymer in which regions or segments of the polymer are in a parallel orientation but have opposite polarities.

As used herein, the term "binds specifically" refers to a binding reaction which is determinative of the presence of a chimeric polypeptide or complex of the present invention in the presence of a heterogeneous population of molecules including macromolecules such as proteins and other biologics. In specific embodiments, the term "binds specifically" when referring to an antigen-binding molecule is used interchangeably with the term "specifically immuno-interactive" and the like to refer to a binding reaction which is determinative of the presence of a chimeric polypeptide or complex of the present invention in the presence of a heterogeneous population of proteins and other biologics. Under designated assay conditions, a molecule binds specifically to a chimeric polypeptide or complex of the invention and does not bind in a significant amount to other molecules (e.g., proteins or antigens) present in the sample. In antigen-binding molecule embodiments, a variety of immunoassay formats may be used to select antigen-binding molecules that are specifically immuno-interactive with a chimeric polypeptide or complex of the invention. For example, solid-phase ELISA immunoassays are routinely used to select monoclonal antibodies that are specifically immuno-interactive with a protein. See Harlow and Lane (1988) Antibodies, A Laboratory Manual, Cold Spring Harbor Publications, New York, for a description of immunoassay formats and conditions that can be used to determine specific immunoreactivity The term "chimeric", when used in reference to a molecule, means that the molecule contains portions that are derived from, obtained or isolated from, or based upon two or more different origins or sources. Thus, a polypeptide is chimeric when it comprises two or more amino acid sequences of different origin and includes (1) polypeptide sequences that are not found together in nature (i.e., at least one of the amino acid sequences is heterologous with respect to at least one of its other amino acid sequences), or (2) amino acid sequences that are not naturally adjoined.

By "coding sequence" is meant any nucleic acid sequence that contributes to the code for the polypeptide product of a gene or for the final mRNA product of a gene (e.g. the mRNA product of a gene following splicing). By contrast, the term "non-coding sequence" refers to any nucleic acid sequence that does not contribute to the code for the polypeptide product of a gene or for the final mRNA product of a gene.

The terms "coiled coil" or "coiled coil structure" are used interchangeably herein to refer to a structural motif in proteins, in which two or more α-helices (most often 2-7 α-helices) are coiled together like the strands of a rope (dimers and trimers are the most common types). Many coiled coil type proteins are involved in important biological functions such as the regulation of gene expression e.g., transcription factors. Coiled coils often, but not always, contain a repeated pattern, hpphppp or hppphpp, of hydrophobic (h) and polar (p) amino-acid residues, referred to as a heptad repeat (see herein below). Folding a sequence with this repeating pattern into an α-helical secondary structure causes the hydrophobic residues to be presented as a ' stripe' that coils gently around the helix in left-handed fashion, forming an amphipathic structure. The most favorable way for two such helices to arrange themselves in a water-filled environment of is to wrap the hydrophobic strands against each other sandwiched between the hydrophilic amino acids. It is thus the burial of hydrophobic surfaces, which provides the thermodynamic driving force for oligomerization of the α-helices. The packing in a coiled-coil interface is exceptionally tight. The α-helices may be parallel or anti-parallel, and usually adopt a left-handed super-coil. Although disfavored, a few right-handed coiled coils have also been observed in nature and in designed proteins. The terms "coiled coil" or "coiled coil structure" will be clear to the person skilled in the art based on the common general knowledge. Particular reference in this regard is made to review papers concerning coiled coil structures, such as for example, Cohen and Parry (1990. *Proteins* 7:1-15); Kohn and Hodges (1998. *Trends Biotechnol* 16:379-389); Schneider et al. (1998. *Fold Des* 3:R29-R40); Harbury et al., (1998. *Science* 282:1462-1467); Mason and Arndt (2004. *ChemBioChem* 5:170-176); Lupas and Gruber (2005. *Adv Protein Chem* 70:37-78); Woolfson (2005. *Adv Protein Chem* 70:79-112); Parry et al. 2008. J Struct Biol 163:258-269); and Mcfarlane et al. (2009. *Eur J Pharmacol* 625:101-107).

As used herein the term "complementary" and grammatically equivalent expressions thereof refer to the characteristic of two or more structural elements (e.g., peptide, polypeptide, nucleic acid, small molecule, or portions thereof etc.) of being able to hybridize, oligomerize (e.g., dimerize), interact or otherwise form a complex with each other. For example, "complementary regions of a polypeptide" are capable of coming together to form a complex, which is characterized in specific embodiments by an antiparallel, two-helix bundle.

As used herein, the term "complex" refers to an assemblage or aggregate of molecules (e.g., peptides, polypeptides, etc.) in direct and/or indirect contact with one another. In specific embodiments, "contact", or more particularly, "direct contact" means two or more molecules are close enough so that attractive noncovalent interactions, such as Van der Waal forces, hydrogen bonding, ionic and hydrophobic interactions, and the like, dominate the interaction of the molecules. In such embodiments, a complex of molecules (e.g., a peptide and polypeptide) is formed under conditions such that the complex is thermodynamically favored (e.g., compared to a non-aggregated, or non-complexed, state of its component molecules). As used herein the term "complex", unless described as otherwise, refers to the assemblage of two or more molecules (e.g., peptides, polypeptides or a combination thereof). In specific embodiments, the term "complex" refers to the assemblage of three polypeptides.

The term "compound library" as used herein refers to any collection of compounds, which includes a plurality of molecules of different structure. Compound libraries may include combinatorial chemical libraries or natural products libraries. Any type of molecule that is capable of interacting, binding or has affinity for a chimeric polypeptide or complex of the present invention, through interactions inclusive of non-covalent interactions, such as, for example, through hydrogen bonds, ionic bonds, van der Waals attractions, or hydrophobic interactions, may be present in the compound library. For example, compound libraries encompasses by this invention may contain naturally-occurring molecules, such as carbohydrates, monosaccharides, oligosaccharides, polysaccharides, amino acids, peptides, oligopeptides, polypeptides, proteins, receptors, nucleic acids, nucleosides, nucleotides, oligonucleotides, polynucleotides, including DNA and DNA fragments, RNA and RNA fragments and the like, lipids, retinoids, steroids, glycopeptides, glycoproteins, proteoglycans and the like; or analogs or derivatives of naturally-occurring molecules, such as peptidomimetics and the like; and non-naturally occurring molecules, such as "small molecule" organic compounds generated, for example, using combinatorial chemistry techniques; and mixtures thereof.

Throughout this specification, unless the context requires otherwise, the words "comprise," "comprises" and "comprising" will be understood to imply the inclusion of a stated step or element or group of steps or elements but not the exclusion of any other step or element or group of steps or elements. Thus, use of the term "comprising" and the like indicates that the listed elements are required or mandatory, but that other elements are optional and may or may not be present. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

As used herein, the terms "conjugated", "linked", "fused" or "fusion" and their grammatical equivalents, in the context of joining together of two more elements or components or domains by whatever means including chemical conjugation or recombinant means (e.g., by genetic fusion) are used interchangeably. Methods of chemical conjugation (e.g., using heterobifunctional crosslinking agents) are known in the art. More specifically, as used herein, an "enveloped virus fusion protein ectodomain"-"structure-stabilizing moiety" fusion or conjugate refers to the genetic or chemical conjugation of an enveloped virus fusion protein ectodomain, which is suitably in a metastable, pre-fusion conformation, to a structure-stabilizing moiety. In specific embodiments, the structure-stabilizing moiety is fused indirectly to a enveloped virus fusion protein ectodomain, via a linker, such as a glycine-serine (gly-ser) linker. In other embodiments, the structure-stabilizing moiety is fused directly to a enveloped virus fusion protein ectodomain A "conservative amino acid substitution" is one in which the amino acid residue is replaced with an amino acid residue having a similar side chain. Families of amino acid residues having similar side chains have been defined in the art, which can be generally sub-classified as follows:

TABLE 1

AMINO ACID SUB-CLASSIFICATION

| SUB-CLASSES | AMINO ACIDS |
| --- | --- |
| Acidic | Aspartic acid, Glutamic acid |
| Basic | Noncyclic: Arginine, Lysine; Cyclic: Histidine |
| Charged | Aspartic acid, Glutamic acid, Arginine, Lysine, Histidine |
| Small | Glycine, Serine, Alanine, Threonine, Proline |
| Polar/neutral | Asparagine, Histidine, Glutamine, Cysteine, Serine, Threonine |
| Polar/large | Asparagine, Glutamine |
| Hydrophobic | Tyrosine, Valine, Isoleucine, Leucine, Methionine, Phenylalanine, Tryptophan |
| Aromatic | Tryptophan, Tyrosine, Phenylalanine |
| Residues that influence chain orientation | Glycine and Proline |

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional polypeptide can readily be determined by assaying its activity. Conservative substitutions are shown in Table 2 under the heading of exemplary and preferred substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

TABLE 2

EXEMPLARY AND PREFERRED AMINO ACID SUBSTITUTIONS

| ORIGINAL RESIDUE | EXEMPLARY SUBSTITUTIONS | PREFERRED SUBSTITUTIONS |
| --- | --- | --- |
| Ala | Val, Leu, Ile | Val |
| Arg | Lys, Gln, Asn | Lys |
| Asn | Gln, His, Lys, Arg | Gln |
| Asp | Glu | Glu |
| Cys | Ser | Ser |
| Gln | Asn, His, Lys, | Asn |
| Glu | Asp, Lys | Asp |
| Gly | Pro | Pro |
| His | Asn, Gln, Lys, Arg | Arg |
| Ile | Leu, Val, Met, Ala, Phe, Norleu | Leu |
| Leu | Norleu, Ile, Val, Met, Ala, Phe | Ile |
| Lys | Arg, Gln, Asn | Arg |
| Met | Leu, Ile, Phe | Leu |
| Phe | Leu, Val, Ile, Ala | Leu |
| Pro | Gly | Gly |
| Ser | Thr | Thr |
| Thr | Ser | Ser |
| Trp | Tyr | Tyr |
| Tyr | Trp, Phe, Thr, Ser | Phe |
| Val | Ile, Leu, Met, Phe, Ala, Norleu | Leu |

The term "construct" refers to a recombinant genetic molecule including one or more isolated nucleic acid sequences from different sources. Thus, constructs are chimeric molecules in which two or more nucleic acid sequences of different origin are assembled into a single nucleic acid molecule and include any construct that contains (1) nucleic acid sequences, including regulatory and coding sequences that are not found together in nature (i.e., at least one of the nucleotide sequences is heterologous with respect to at least one of its other nucleotide sequences), or (2) sequences encoding parts of functional RNA molecules or proteins not naturally adjoined, or (3) parts of promoters that are not naturally adjoined. Representative constructs include any recombinant nucleic acid molecule such as a plasmid, cosmid, virus, autonomously replicating polynucleotide molecule, phage, or linear or circular single stranded or double stranded DNA or RNA nucleic acid molecule, derived from any source, capable of genomic integration or autonomous replication, comprising a nucleic acid molecule where one or more nucleic acid molecules have been operably linked. Constructs of the present invention will generally include the necessary elements to direct expression of a nucleic acid sequence of interest that is also contained in the construct, such as, for example, a target nucleic acid sequence or a modulator nucleic acid sequence. Such elements may include control elements such as a promoter that is operably linked to (so as to direct transcription of) the nucleic acid sequence of interest, and often includes a polyadenylation sequence as well. Within certain embodiments of the invention, the construct may be contained within a vector. In addition to the components of the construct, the vector may include, for example, one or more selectable markers, one or more origins of replication, such as prokaryotic and eukaryotic origins, at least one multiple cloning site, and/or elements to facilitate stable integration of the construct into the genome of a host cell. Two or more constructs can be contained within a single nucleic acid molecule, such as a single vector, or can be containing within two or more separate nucleic acid molecules, such as two or more separate vectors. An "expression construct" generally includes at least a control sequence operably linked to a nucleotide sequence of interest. In this manner, for example, promoters in operable connection with the nucleotide sequences to be expressed are provided in expression constructs for expression in an organism or part thereof including a host cell. For the practice of the present invention, conventional compositions and methods for preparing and using constructs and host cells are well known to one skilled in the art, see for example, Molecular Cloning: A Laboratory Manual, $3^{rd}$ edition Volumes 1, 2, and 3. J. F. Sambrook, D. W. Russell, and N. Irwin, Cold Spring Harbor Laboratory Press, 2000.

By "corresponds to" or "corresponding to" is meant an amino acid sequence that displays substantial sequence similarity or identity to a reference amino acid sequence. In general the amino acid sequence will display at least about 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence similarity or identity to at least a portion of the reference amino acid sequence.

The term "domain", as used herein, refers to a part of a molecule or structure that shares common physicochemical features, such as, but not limited to, hydrophobic, polar, globular and helical domains or properties such as ligand-binding, membrane fusion, signal transduction, cell penetration and the like. Often, a domain has a folded protein structure which has the ability to retain its tertiary structure independently of the rest of the protein. Generally, domains are responsible for discrete functional properties of proteins, and in many cases may be added, removed or transferred to other proteins without loss of function of the remainder of the protein and/or of the domain. Domains may be co-extensive with regions or portions thereof; domains may also include distinct, non-contiguous regions of a molecule. Examples of protein domains include, but are not limited to, a cellular or extracellular localization domain (e.g., signal peptide; SP), an immunoglobulin (Ig) domain, a membrane fusion (e.g., fusion peptide; FP) domain, an ectodomain, a membrane proximal external region (MPER) domain, a transmembrane (TM) domain, and a cytoplasmic (C) domain.

By "effective amount," in the context of eliciting an immune response to a fusion protein of an enveloped virus, or complex of the fusion protein, or of treating or preventing a disease or condition, is meant the administration of an amount of agent to an individual in need thereof, either in a single dose or as part of a series, that is effective for that elicitation, treatment or prevention. The effective amount will vary depending upon the health and physical condition of the individual to be treated, the taxonomic group of individual to be treated, the formulation of the composition, the assessment of the medical situation, and other relevant factors. It is expected that the amount will fall in a relatively broad range that can be determined through routine trials.

The term "endogenous" refers to a polypeptide or part thereof that is present and/or naturally expressed within a host organism or cell thereof. For example, an "endogenous" ectodomain polypeptide or part thereof refers to an ectodomain polypeptide of an enveloped fusion protein or a part of that ectodomain that is naturally expressed in enveloped virus.

As used herein, the term "endogenous HRA region" refers to an HRA region that is present in a Class I ectodomain polypeptide at substantially the same position as the HRA region in the amino acid sequence of the fusion protein precursor form of the naturally occurring fusion protein. The approximate amino acid positions of endogenous HRA regions of non-limiting examples of class I fusion proteins are listed in Table 3.

TABLE 3

APPROXIMATE POSITIONS OF HRA REGIONS IN SELECTED CLASS I FUSION PROTEINS

| Class I Fusion Protein | HRA region | |
|---|---|---|
| | Start position | End position |
| Influenza A hemagglutinin (HA) | 356 | 390 |
| Influenza B HA | 383 | 416 |
| RSV Fusion protein (F) | 164 | 196 |
| hMPV F | 126 | 169 |
| PIV F | 136 | 168 |
| Measles F | 138 | 171 |
| Hendra | 136 | 169 |
| Nipah F | 136 | 169 |
| HIV glycoprotein (GP) 160 | 539 | 587 |
| Ebola GP | 557 | 593 |
| Marburg GP | 582 | 598 |
| SARS spike protein (S) | 892 | 1013 |
| MERS S | 984 | 1105 |

As used herein, the term "endogenous HRB region" refers to an HRB region that is present in a Class I ectodomain polypeptide at substantially the same position as the HRB region in the amino acid sequence of the fusion protein precursor form of the naturally occurring fusion protein. The approximate amino acid positions of endogenous HRB regions of non-limiting examples of class I fusion proteins are listed Table 4.

TABLE 4

APPROXIMATE POSITIONS OF HRB REGIONS IN SELECTED CLASS I FUSION PROTEINS

| Class I Fusion Protein | HRB region | |
|---|---|---|
| | Start position | End position |
| Influenza A HA | 421 | 469 |
| Influenza B HA | 436 | 487 |
| RSV F | 488 | 524 |
| hMPV F | 456 | 490 |
| PIV F | 458 | 493 |
| Measles F | 454 | 493 |
| Hendra | 456 | 487 |
| Nipah F | 456 | 487 |
| HIV GP160 | 631 | 667 |
| Ebola GP | 600 | 635 |
| Marburg GP | 611 | 627 |
| SARS S | 1145 | 1187 |
| MERS S | 1248 | 1291 |

The term "endogenous production" refers to expression of a nucleic acid in an organism and the associated production and/or secretion of an expression product of the nucleic acid in the organism. In specific embodiments, the organism is multicellular (e.g., a vertebrate animal, preferably a mammal, more preferably a primate such as a human) and the nucleic acid is expressed within cells or tissues of the multicellular organism.

As used herein, "enveloped virus fusion ectodomain polypeptide" refers to a polypeptide that contains an virion surface exposed portion of a mature enveloped virus fusion protein, with or without the signal peptide but lacks the transmembrane domain and cytoplasmic tail of the naturally occurring enveloped virus fusion protein.

The terms "epitope" and "antigenic determinant" are used interchangeably herein to refer to an antigen, typically a protein determinant, that is capable of specific binding to an antibody (such epitopes are often referred to as "B cell epitopes") or of being presented by a Major Histocompatibility Complex (MHC) protein (e.g., Class I or Class II) to a T-cell receptor (such epitopes are often referred to as "T cell epitopes"). Where a B cell epitope is a peptide or polypeptide, it typically comprises three or more amino acids, generally at least 5 and more usually at least 8 to 10 amino acids. The amino acids may be adjacent amino acid residues in the primary structure of the polypeptide (often referred to as contiguous peptide sequences), or may become spatially juxtaposed in the folded protein (often referred to as non-contiguous peptide sequences). T cell epitopes may bind to MHC Class I or MHC Class II molecules. Typically MHC Class I-binding T cell epitopes are 8 to 11 amino acids long. Class II molecules bind peptides that may be 10 to 30 residues long or longer, the optimal length being 12 to 16 residues. The ability of a putative T cell epitope to bind to an MHC molecule can be predicted and confirmed experimentally (Dimitrov et al., 2010. Bioinformatics 26(16): 2066-8).

The term "helix bundle" refers to a plurality of peptide helices that fold such that the helices are substantially parallel or anti-parallel to one another. A two-helix bundle has two helices folded such that they are substantially parallel or anti-parallel to one another. Likewise, a six-helix bundle has six helices folded such that they are substantially parallel or anti-parallel to one another. By "substantially parallel or anti-parallel" is meant that the helices are folded such that the side chains of the helices are able to interact with one another. For example, the hydrophobic side chains of the helices are able to interact with one another to form a hydrophobic core.

The term "heterologous" as used herein refers to any proteinaceous moiety whose sequence is chosen in such a way that the product of the fusion of this sequence with an ectodomain polypeptide has a sequence different from a precursor or mature form of a wild-type enveloped virus fusion protein.

The term "host" refers to any organism, or cell thereof, whether eukaryotic or prokaryotic into which a construct of the invention can be introduced, particularly, hosts in which RNA silencing occurs. In particular embodiments, the term "host" refers to eukaryotes, including unicellular eukaryotes such as yeast and fungi as well as multicellular eukaryotes such as animals non-limiting examples of which include invertebrate animals (e.g., insects, cnidarians, echinoderms, nematodes, etc.); eukaryotic parasites (e.g., malarial parasites, such as *Plasmodium falciparum*, helminths, etc.); vertebrate animals (e.g., fish, amphibian, reptile, bird, mammal); and mammals (e.g., rodents, primates such as humans and non-human primates). Thus, the term "host cell" suitably encompasses cells of such eukaryotes as well as cell lines derived from such eukaryotes.

Reference herein to "immuno-interactive" includes reference to any interaction, reaction, or other form of association between molecules and in particular where one of the molecules is, or mimics, a component of the immune system.

As use herein, the term "immunogenic composition" or "immunogenic formulation" refers to a preparation which, when administered to a vertebrate, especially an animal such as a mammal, will induce an immune response.

By "linker" is meant a molecule or group of molecules (such as a monomer or polymer) that connects two molecules and often serves to place the two molecules in a desirable configuration.

As used herein, the term "meta-stable", as used in the context of a protein (e.g., an enveloped virus ectodomain polypeptide), refers to a labile conformational state that rapidly converts to a more stable conformational state upon a change in conditions. For example, an enveloped virus fusion protein in a pre-fusion form is in a labile, meta-stable conformation, and converts to the more stable post-fusion conformation upon, e.g., fusion to a host cell.

As used herein, the term "moiety" refers to a portion of a molecule, which may be a functional group, a set of functional groups, and/or a specific group of atoms within a molecule, that is responsible for a characteristic chemical, biological, and/or medicinal property of the molecule.

The term "neutralizing antigen-binding molecule" refers to an antigen-binding molecule that binds to or interacts with a target molecule or ligand and prevents binding or association of the target antigen to a binding partner such as a receptor or substrate, thereby interrupting the biological response that otherwise would result from the interaction of the molecules. In the case of the instant invention a neutralizing antigen-binding molecule suitably associates with a metastable or pre-fusion form of an enveloped virus fusion protein and preferably interferes or reduces binding and/or fusion of the fusion protein to a cell membrane.

The term "oligomer" refers to a molecule that consists of more than one but a limited number of monomer units in contrast to a polymer that, at least in principle, consists of an unlimited number of monomers. Oligomers include, but are not limited to, dimers, trimers, tetramers, pentamers, hexamers, heptamers, octamers, nonamers, decamers and the like. An oligomer can be a macromolecular complex formed by non-covalent bonding of macromolecules like proteins. In this sense, a homo-oligomer would be formed by identical molecules and by contrast, a hetero-oligomer would be made of at least two different molecules. In specific embodiments, an oligomer of the invention is a trimeric polypeptide complex consisting of three polypeptide subunits. In these embodiments, the trimeric polypeptide may be a "homotrimeric polypeptide complex" consisting of three identical polypeptide subunits, or a "heterotrimeric polypeptide complex" consisting of three polypeptide subunits in which at least one subunit polypeptide is non-identical. A "polypeptide subunit" is a single amino acid chain or monomer that in combination with two other polypeptide subunits forms a trimeric polypeptide complex.

The term "operably connected" or "operably linked" as used herein refers to a juxtaposition wherein the components so described are in a relationship permitting them to function in their intended manner. For example, a regulatory sequence (e.g., a promoter) "operably linked" to a nucleotide sequence of interest (e.g., a coding and/or non-coding sequence) refers to positioning and/or orientation of the control sequence relative to the nucleotide sequence of interest to permit expression of that sequence under conditions compatible with the control sequence. The control sequences need not be contiguous with the nucleotide sequence of interest, so long as they function to direct its expression. Thus, for example, intervening non-coding sequences (e.g., untranslated, yet transcribed, sequences) can be present between a promoter and a coding sequence, and the promoter sequence can still be considered "operably linked" to the coding sequence. Likewise, "operably connecting" an enveloped virus fusion ectodomain polypeptide to a heterologous, structure-stabilizing moiety encompasses positioning and/or orientation of the structure-stabilizing moiety such that the complementary HR1 and HR2 regions are permitted to associate with each other under conditions suitable for their association (e.g., in aqueous solution) to form an anti-parallel, two-helix bundle.

The terms "patient", "subject", "host" or "individual" used interchangeably herein, refer to any subject, particularly a vertebrate subject, and even more particularly a mammalian subject, for whom therapy or prophylaxis is desired. Suitable vertebrate animals that fall within the scope of the invention include, but are not restricted to, any member of the subphylum Chordata including primates (e.g., humans, monkeys and apes, and includes species of monkeys such from the genus *Macaca* (e.g., cynomologus monkeys such as *Macaca fascicularis,* and/or rhesus monkeys (*Macaca mulatta*)) and baboon (*Papio ursinus*), as well as marmosets (species from the genus *Calithrix*), squirrel monkeys (species from the genus *Saimiri*) and tamarins (species from the genus *Saguinus*), as well as species of apes such as chimpanzees (*Pan troglodytes*)), rodents (e.g., mice rats, guinea pigs), lagomorphs (e.g., rabbits, hares), bovines (e.g., cattle), ovines (e.g., sheep), caprines (e.g., goats), porcines (e.g., pigs), equines (e.g., horses), canines (e.g., dogs), felines (e.g., cats), avians (e.g., chickens, turkeys, ducks, geese, companion birds such as canaries, budgerigars etc.), marine mammals (e.g., dolphins, whales), reptiles (snakes, frogs, lizards etc.), and fish. A preferred subject is a human in need of eliciting an immune response to a fusion protein of an enveloped virus, or complex of the fusion protein. However, it will be understood that the aforementioned terms do not imply that symptoms are present.

By "pharmaceutically acceptable carrier" is meant a solid or liquid filler, diluent or encapsulating substance that can be safely used in topical or systemic administration to an animal, preferably a mammal, including humans. Representative pharmaceutically acceptable carriers include any and all solvents, dispersion media, coatings, surfactants, antioxidants, preservatives (e.g., antibacterial agents, antifungal agents), isotonic agents, absorption delaying agents, salts, preservatives, drugs, drug stabilizers, gels, binders, excipients, disintegration agents, lubricants, sweetening agents, flavoring agents, dyes, such like materials and combinations thereof, as would be known to one of ordinary skill in the art (see, for example, Remington's Pharmaceutical Sciences, 18th Ed. Mack Printing Company, 1990, pp. 1289-1329, incorporated herein by reference). Except insofar as any conventional carrier is incompatible with the active ingredient(s), its use in the pharmaceutical compositions is contemplated.

The term "polynucleotide" or "nucleic acid" as used herein designates mRNA, RNA, cRNA, cDNA or DNA. The term typically refers to polymeric forms of nucleotides of at least 10 bases in length, either ribonucleotides or deoxynucleotides or a modified form of either type of nucleotide. The term includes single and double stranded forms of DNA.

"Polypeptide", "peptide", "protein" and "proteinaceous molecule" are used interchangeably herein to refer to molecules comprising or consisting of a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers.

As used herein, the term "post-fusion conformation" of a fusion protein of an enveloped virus refers to the structure of an enveloped virus fusion protein, which is in a terminal conformation (i.e., formed at the end of the fusion process) and is the most energetically favorable state. In the post-fusion conformation, the fusion peptides or loops of the fusion protein are brought into close proximity with the fusion protein transmembrane domain. The specific structural elements that facilitate formation of the hairpin structure vary according to the class of enveloped fusion protein. For example, the post-fusion conformation of a Class I fusion protein is characterized by interaction between the endogenous HRA region and the endogenous HRB region of individual Class I fusion proteins to form a hairpin structure characterized by a six-helix bundle, comprising three endogenous HRB and three endogenous HRA regions. Alternatively, the post-fusion conformation of a Class III fusion protein is characterized by interaction between the internal fusion loops and the C-terminal transmembrane region which facilitates the formation of a hairpin structure. Post-fusion conformations of individual viral fusion proteins have been determined by electron microscopy and/or x-ray crystallography, such structures are readily identifiable when viewed in negatively stained electron micrographs and/or by a lack of pre-fusion epitopes.

As used herein, the term "pre-fusion conformation" of a fusion protein of an enveloped virus refers to the structure of an enveloped virus fusion protein, which is in a meta-stable confirmation (i.e., in a semi-stable conformation that is not the most energetically favorable terminal conformation) and upon appropriate triggering is able to undergo conformational rearrangement to the terminal post-fusion conformation. Typically pre-fusion conformations of viral fusion proteins contain an hydrophobic sequence, referred to as the fusion peptide or fusion loop, that is located internally within the pre-fusion conformation and cannot interact with either the viral or host cell membranes. Upon triggering this hydrophobic sequence is inserted into the host cell membrane and the fusion protein collapses into the post-fusion hairpin like conformation. The pre-fusion conformation of viral fusion proteins vary according to the class of enveloped fusion protein. Each class is characterized by non-interacting structural elements that subsequently associate in the energetically favorable post-fusion conformation. For example, the pre-fusion conformation of a Class I fusion protein is dependent on the endogenous HRA region not interacting with the endogenous HRB region of individual fusion proteins of the trimer, thereby not permitting formation of a hairpin structure characterized by a six-helix bundle. Alternatively, the pre-fusion conformation of a Class III fusion protein is dependent a central α-helical coiled coil not interacting with fusion loop(s) at the C-terminal region of individual fusion proteins of the trimer, thereby not permitting formation of a hairpin structure. Pre-fusion conformations of individual viral fusion proteins have been determined by electron microscopy and/or x-ray crystallography, such structures are readily identifiable when viewed in negatively stained electron micrographs and/or by pre-fusion epitopes that are not present on post-fusion conformations.

"Regulatory elements", "regulatory sequences", control elements", "control sequences" and the like are used interchangeably herein to refer to nucleotide sequences located upstream (5' non-coding sequences), within, or downstream (3' non-coding sequences) of a coding sequence, and which influence the transcription, RNA processing or stability, or translation of the associated coding sequence, either directly or indirectly. Regulatory elements include enhancers, promoters, translation leader sequences, introns, Rep recognition element, intergenic regions and polyadenylation signal sequences. They include natural and synthetic sequences as well as sequences which may be a combination of synthetic and natural sequences.

The term "replicon" refers to any genetic element, e.g., a plasmid, a chromosome, a virus, a cosmid, etc., that behaves as an autonomous unit of polynucleotide replication within a cell, i.e., capable of replication under its own control.

"Self-assembly" refers to a process of spontaneous assembly of a higher order structure that relies on the natural attraction of the components of the higher order structure (e.g., molecules) for each other. It typically occurs through random movements of the molecules and formation of bonds based on size, shape, composition, or chemical properties.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. The present invention contemplates the use in the methods and systems of the present invention of full-length IL-22 polypeptides as well as their biologically active fragments. Typically, biologically active fragments of a full-length IL-22 polypeptide may participate in an interaction, for example, an intra-molecular or an inter-molecular interaction.

"Similarity" refers to the percentage number of amino acids that are identical or constitute conservative substitutions as defined in Tables 1 and 2 supra. Similarity may be determined using sequence comparison programs such as GAP (Deveraux et al. 1984, *Nucleic Acids Research* 12: 387-395). In this way, sequences of a similar or substantially different length to those cited herein might be compared by insertion of gaps into the alignment, such gaps being determined, for example, by the comparison algorithm used by GAP.

Terms used to describe sequence relationships between two or more polynucleotides or polypeptides include "reference sequence," "comparison window", "sequence identity," "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

As used herein, the term "single-chain" refers to a molecule comprising amino acid monomers linearly linked by peptide bonds.

As used herein a "small molecule" refers to a composition that has a molecular weight of less than 3 kilodaltons (kDa), and typically less than 1.5 kilodaltons, and more preferably less than about 1 kilodalton. Small molecules may be nucleic acids, peptides, polypeptides, peptidomimetics, carbohydrates, lipids or other organic (carbon-containing) or inorganic molecules. As those skilled in the art will appreciate, based on the present description, extensive libraries of chemical and/or biological mixtures, often fungal, bacterial, or algal extracts, may be screened with any of the assays of the invention to identify compounds that modulate a bioactivity. A "small organic molecule" is an organic compound (or organic compound complexed with an inorganic compound (e.g., metal)) that has a molecular weight of less than 3 kilodaltons, less than 1.5 kilodaltons, or even less than about 1 kDa.

As used herein, the terms "treatment", "treating", and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse affect attributable to the disease. "Treatment", as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "wild-type", "native" and "naturally occurring" are used interchangeably herein to refer to a gene or gene product that has the characteristics of that gene or gene product when isolated from a naturally occurring source. A wild type, native or naturally occurring gene or gene product (e.g., a polypeptide) is that which is most frequently observed in a population and is thus arbitrarily designed the "normal" or "wild-type" form of the gene or gene product.

Each embodiment described herein is to be applied mutatis mutandis to each and every embodiment unless specifically stated otherwise.

2. Chimeric Polypeptides

The present invention is predicated in part on a novel strategy for artificially stabilizing or 'clamping' an enveloped virus fusion protein ectodomain polypeptide in a pre-fusion conformation. This 'molecular clamping' strategy employs fusion or linkage of a structure-stabilizing moiety to an ectodomain polypeptide to form a chimeric polypeptide. The structure-stabilizing moiety is typically a single-chain polypeptide comprising complementary heptad repeats that lack complementarity to the ectodomain polypeptide and that therefore preferentially associate with each other rather than with structural elements of the ectodomain polypeptide. Association of the complementary heptad repeats to one another under conditions suitable for their association (e.g., in aqueous solution) results in formation of an anti-parallel, two-helix bundle that inhibits rearrangement of the ectodomain polypeptide to a post-fusion conformation. The two-helix bundle of the structure-stabilizing moiety can trimerize to form a highly stable six-helix bundle, thus permitting self assembly of the chimeric polypeptide to form an artificial enveloped virus fusion protein complex. The complex so assembled can mimic the pre-fusion conformation of a native enveloped virus fusion protein complex and comprises three chimeric polypeptides, characterized by a six-helix bundle formed by the coiled coil structures of the respective structure-stabilizing moieties of the chimeric polypeptides.

2.1 Structure-Stabilizing Moieties

The present inventors have constructed a single-chain polypeptide moiety comprising complementary heptad repeats that fold into an anti-parallel configuration, forming an anti-parallel, two-helix bundle that stabilizes an operably connected enveloped virus ectodomain polypeptide in a pre-fusion conformation. The two-helix bundle suitably forms a coiled coil structure. The coiled coil fold occurs in a wide variety of proteins including motor proteins, DNA-binding proteins, extracellular proteins and viral fusion proteins (see, e.g., Burkhard et al., 2001. *Trends Cell Biol* 11:82-88). Coiled coils have been functionally characterized as folding (assembly, oligomerization) motifs, i.e., formation of a coiled coil structure drives in many instances the non-covalent association of different protein chains. Coiled coils have been structurally characterized as 2-, 3-, 4- or 5-stranded assemblies of α-helices arranged in parallel, anti-parallel or mixed topologies (see, e.g., Lupas, 1996. *Trends Biochem Sci* 21:375-382). Usually, the helices are slightly wrapped (coiled, wound) around each other in a left- or right-handed manner, termed supercoiling. It will be understood that the two-helix bundles of the present invention generally form coiled coil structures with a strong propensity to trimerize in order to form a highly stable six-helical coiled coil bundle.

2.1.1 Heptad Repeats

Alpha-helical coiled coils have been characterized at the level of their amino acid sequences, in that, each helix is constituted of a series of heptad repeats. A heptad repeat (heptad unit, heptad) is a 7-residue sequence motif which can be encoded as hpphppp, and wherein each 'h' represents a hydrophobic residue and each 'p' is a polar residue. Occasionally, p-residues are observed at h-positions, and vice versa. A heptad repeat is also often encoded by the patterns a-b-c-d-e-f-g (abcdefg) or d-e-f-g-a-b-c (defgabc), in which case the indices 'a' to 'g' refer to the conventional heptad positions at which typical amino acid types are observed. By convention, indices 'a' and 'd' denote the positions of the core residues (central, buried residues) in a coiled coil. The typical amino acid types that are observed at core a- and d-positions are hydrophobic amino acid residue types; at all other positions (non-core positions), predominantly polar (hydrophilic) residue types are observed. Thus, conventional heptad patterns 'hpphppp' match with the pattern notation 'abcdefg' ('hppphpp' patterns match with the pattern notation 'defgabc', this notation being used for coiled coils starting with a hydrophobic residue at a d-position). The heptad repeat regions of the present invention include at least 2, and suitably 3 or more consecutive (uninterrupted) heptad repeats in individual α-helices of the coiled coil structure. Each series of consecutive heptad repeats in a helix is denoted a 'heptad repeat sequence' (HRS). The start and end of a heptad repeat sequence is preferably determined on the basis of the experimentally determined 3-dimensional (3-D) structure, if available. If a 3-D structure is not available, the start and end of a heptad repeat sequence is preferably determined on the basis of an optimal overlay of a (hpphppp)$_n$ or (hppphpp)$_n$ pattern with the actual amino acid sequence, where 'h' and 'p' denote hydrophobic and polar residues, respectively, and where 'n' is a number equal to or greater than 2. The start and end of each heptad repeat sequence is taken to be the first and last hydrophobic residue at an a- or d-position, respectively. Conventional H-residues are preferably selected from the group consisting of valine, isoleucine, leucine, methionine, phenylalanine, tyrosine, tryptophan, histidine, glutamine, threonine, serine and alanine, more preferably from the group consisting of valine, isoleucine, leucine and methionine, and most preferably isoleucine. Conventional p-residues are preferably selected from the group consisting of glycine, alanine, cysteine, serine, threonine, histidine, asparagine, aspartic acid, glutamine, glutamic acid, lysine and arginine. In case this method does not permit unambiguous assignment of amino acid residues to a heptad repeat sequence, a more specialized analysis method can be applied, such as the COILS method of Lupas et al. (1991. *Science* 252:1162-1164; http://www.russell.embl-heidelberg.de/cgi-bin/coils-svr.pl).

In particular embodiments, each heptad repeat region (HR1, HR2) is independently characterized by a n-times repeated 7-residue pattern of amino acid types, represented as (a-b-c-d-e-f-g-)$_n$ or (d-e-f-g-a-b-c-)$_n$, as described for example in WO 2010/066740, the content of which is incorporated by reference herein in its entirety, wherein the pattern elements 'a' to 'g' denote conventional heptad positions at which the amino acid types are located and n is a number equal to or greater than 2, and at least 50% (or at least 51% to at least 99% and all integer percentages in between) of the conventional heptad positions 'a' and 'd' are occupied by hydrophobic amino acid types and at least 50% (or at least 51% to at least 99% and all integer percentages in between) of the conventional heptad positions 'b', 'c', 'e', 'f' and 'g' are occupied by hydrophilic amino acid types, the resulting distribution between hydrophobic and hydrophilic amino acid types enabling the identification of the heptad repeat regions. In specific embodiments, at least 50%, 70%, 90%, or 100% of the conventional heptad positions 'a' and 'd' are occupied by amino acids selected from the group consisting of valine, isoleucine, leucine, methionine or non-natural derivatives thereof. Since the latter amino acids correspond to more standard (more frequently observed) coiled coil core residues. In other embodiments, at least 50%, 70%, 90%, or 100% of the conventional heptad positions 'a' and 'd' are occupied by isoleucines. In some embodiments, at least 50%, 70%, 90%, or 100% of the conventional heptad positions 'b', 'c', 'e', 'f' and 'g' are occupied by amino acids selected from the group consisting of glycine, alanine, cysteine, serine, threonine, histidine, asparagine, aspartic acid, glutamine, glutamic acid, lysine, arginine or non-natural derivatives thereof. In illustrative examples of this type, the HR1 and HR2 regions comprise, consist or consist essentially of the sequence: IEE-IQKQIAAIQKQIAAIQKQIYRM [SEQ ID NO: 1]

In particular embodiments, the HR1 and HR2 regions of the structure-stabilizing moiety (also referred to herein as "SSM") comprise at least one endogenous heptad repeat of a Class I enveloped virus fusion protein. Suitably, the HR1 and HR2 regions are formed largely by complementary HRA and HRB regions, respectively, of one or more Class I enveloped virus fusion proteins. The HRA region amino acid sequence and the HRB region amino acid sequence may be derived from the same Class I enveloped virus fusion protein. Alternatively, they may be derived from the different Class I enveloped virus fusion proteins. In representative examples, the HR1 and HR2 regions are independently selected from HRA and HRB regions of orthomyxoviruses (e.g., Influenza A (Inf A), Influenza B (Inf B), Influenza C (Inf C)), paramyxoviruses (e.g., Measles (MeV), Rinderpest virus (RPV), Canine distemper virus (CDV), RSV, Human Metapneumovirus (HMPV), Parainfluenza virus (PIV), Mumps virus (MuV), Hendra virus (HeV), Nipah virus (NiV), Newcastle disease virus (NDV)), retroviruses (e.g., Human T cell leukemia virus type 1 (HTLV-1), HTLV-2, HTLV-3, HIV-1, HIV-2), filoviruses (e.g., Ebola virus (EBOV) including Zaire (ZEBOV), Reston (REBOV) and Sudan (SEBOV) strains, Marburg virus (MARV)), arenaviruses (e.g., Lassa virus (LASV), Lymphocytic choriomeningitis virus (LCMV), Junin virus (JUNV)), and coronaviruses (e.g., Human Coronavirus (HCoV), including HCoV 229E, HCoV OC43, HCoV HKU1, HCoV EMC, Human Torovirus (HToV), Middle East Respiratory Syndrome virus (MERS-CoV), Severe Acute Respiratory Syndrome virus (SARS-CoV)).

Exemplary HRA region amino acid sequences include, but are not limited to, those in Table 5:

TABLE 5

| HRA REGION SEQUENCES OF SELECTED CLASS I FUSION PROTEINS | |
|---|---|
| VIRUS | HRA REGION SEQUENCE |
| HIV GP160 | SGIVQQQNNLLRAIEAQQHLLQLTVWGIKQLQARILA [SEQ ID NO: 2] (GenPept dbjBAF31430.1) |
| RSV F | LHLEGEVNKIKSALLSTNKAVVSLGNGVSVLTSKVLDLK [SEQ ID NO: 3] (GenPept gbAHL84194.1) |

TABLE 5-continued

HRA REGION SEQUENCES OF SELECTED CLASS I FUSION PROTEINS

| VIRUS | HRA REGION SEQUENCE |
|---|---|
| HMPV F | IRLESEVTAIKNALKKTNEAVSTLGNGVRVLATAVRELK [SEQ ID NO: 4] (GenPept gbAAN52913.1) |
| PIV F | KQARSDIEKLKEAIRDTNKAVQSVQSSIGNLIVAIKSVQ [SEQ ID NO: 5] (GenPept gbAAB21447.1) |
| MeV F | MLNSQAIDNLRASLETTNQAIEAIRQAGQEMILAVQGVQ [SEQ ID NO: 6] (GenPept dbjBAB60865.1) |
| HeV F | MKNADNINKLKSSIESTNEAVVKLQETAEKTVYVLTALQ [SEQ ID NO: 7] (GenPept NP_047111.2) |
| InF A HA | ENGWEGMVDGWYGFRHQNSEGTGQAADLKSTQAAI [SEQ ID NO: 8] (GenPept gbAEC23340.1) |
| InF B HA | HGYTSHGAHGVAVAADLKSTQEAINKITKNLNYL [SEQ ID NO: 9] (GenPept gbAFH57854.1) |
| EBOV GP | GLRQLANETTQALQLFLRATTELRTFSILNRKAIDFL [SEQ ID NO: 10] (GenPept NP_066246.1) |
| MARV GP | LANQTAKSLELLLRVTTEERTFSLINRHAIDFLLTRWG [SEQ ID NO: 11] (GenPept YP_001531156.1) |
| MERS S | ISASIGDIIQRLDVLEQDAQIDRLINGRLTTLNAFVAQQLVRSESAALSAQLAKDKVNE [SEQ ID NO: 12] (GenPept gbAHX00711.1) |
| SARS S | ISSVLNDILSRLDKVEAEVQIDRLITGRLQSLQTYVTQQLIRAAEIRASANLAATKMSE [SEQ ID NO: 13] (GenPept abAAR86788.1] |

Exemplary HRB region amino acid sequences include, but are not limited to, those in Table 6:

TABLE 6

HRB REGION SEQUENCES OF SELECTED CLASS I FUSION PROTEINS

| VIRUS | HRB REGION SEQUENCE |
|---|---|
| HIV GP160 | HTTWMEWDREINNYTSLIHSLIEESQNQQEKNEQELLE [SEQ ID NO: 14] (GenPept dbjBAF31430.1) |
| RSV F | FDASISQVNEKINQSLAFIRKSDELLHNVNAGKSTTN [SEQ ID NO: 15] (GenPept gbAHL84194.1) |
| hMPV F | FNVALDQVFESIENSQALVDQSNRILSSAEKGNTG [SEQ ID NO: 16] (GenPept gbAAN52913.1] |
| PIV F | IELNKAKSDLEESKEWIRRSNQKLDSIGNWHQSSTT [SEQ ID NO: 17] (GenPept gbAAB21447.1) |
| MeV F | LERLDVGTNLGNAIAKLEDAKELLESSDQILRSMKGLSST [SEQ ID NO: 18] (GenPept dbjBAB60865.1) |
| HeV F | ISSQISSMNQSLQQSKDYIKEAQKILDTVNPS [SEQ ID NO: 19] (GenPept NP_047111.2) |
| Inf A HA | RIQDLEKYVEDTKIDLWSYNAELVLALENQHTIDLTDSEMSKLFERTRR [SEQ ID NO: 20] (GenPept gbAEC23340.1] |
| Inf B HA | DEILELDEKVDDLRADTISSQIELAVLLSNEGIINSEDEHLLALERKLKKML [SEQ ID NO: 21] (GenPept gbAFH57854.1] |
| EBOV GP | HDWTKNITDKIDQIIHDFVDKTL [SEQ ID NO: 22] (GenPept NP_066246.1] |
| MARV GP | IGIEDLSKNISEQIDQI [SEQ ID NO: 23] (GenPept YP_001531156.1] |
| MERS S | NFGSLTQINTTLLDLTYEMLSLQQVVKALNESYIDLKELGNYTY [SEQ ID NO: 24] (GenPept gbAHX00711.1] |
| SARS S | DVDLGDISGINASVVNIQKEIDRLNEVAKNLNESLIDLQELGK [SEQ ID NO: 25] (GenPept gbAAR86788.1] |

The HR1 and HR2 regions are capable of coming together to form an oligomer typically a hexamer composed of three HR1 regions and three HR2 regions, which is thermodynamically stable and typifies the post-fusion conformation of class I viral fusion proteins. HR1 and HR2 regions with a strong propensity to oligomerize are referred to herein as "complementary" heptad repeat regions. Non-limiting examples of such heptad repeat regions those listed in Table 7.

In particular embodiments, the structure-stabilizing moiety, including one or both of the heptad repeat regions, includes an immune-silencing or suppressing moiety that inhibits elicitation or production of an immune response to the structure-stabilizing moiety, particularly when folded into an anti-parallel, two-helix bundle. These embodiments are advantageous as they can permit the generation of a stronger or enhanced immune response to the ectodomain polypeptide or complex thereof. The immune-silencing moiety can be a glycosylation site that is specifically recognized and glycosylated by a glycosylation enzyme, in particular a glycosyltransferase. Glycosylations can be N-linked or O-linked. N-linked refers to the attachment of the carbohydrate moiety to the side chain of an asparagine residue. The tripeptide sequences N—X—S and N-X-T, where X is any amino acid except P, are the recognition sequences for enzymatic attachment of the carbohydrate moiety to the asparagine side chain, and these sequences are commonly referred to as 'glycosylation sites'. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used. The immune-silencing moiety may be inserted into the structure stabilizing moiety, including one or both of the heptad repeat regions.

In other embodiments, unnatural or nonnative amino acids can be incorporated into one or both of the heptad repeat regions using an expanded genetic code. The nonnative amino acids are biosynthetically incorporated into a desired location using tyrosyl-tRNA/aminoacyl-tRNA synthetase orthogonal pair and a nonsense codon at the desired site. The nonnative or unnatural amino acids are supplied to cells expressing a construct from which the chimeric polypeptide is expressible, from an external source and this strategy can incorporate side chains with a wide range of physical attributes including, but not limited to, chemical crosslinking group (e.g., azide or haloalkane), a trackable maker (e.g., fluorescent or radioactive) and photosensitive groups to enable temporally controlled modifications. To these unnatural amino acids various moieties can be covalently linked by chemical addition to the structure-stabilizing moiety to provide advantageous properties.

Further embodiments may include any possible combination of the above examples, or additional unnatural chemical addition, covalently linked to the structure-stabilizing moiety.

Optionally, one or more additional cysteine residues may be inserted into the HR1 and/or HR2 regions to form disulfide bonds and further stabilize the anti-parallel, α-helical coiled coil structure of the structure stabilizing moiety.

2.1.2 Linkers

The structure-stabilizing moiety of the present invention suitably comprises a linker that spaces the heptad repeat regions (also referred to herein as HR1 and HR2). The linker generally includes any amino acid residue that cannot be unambiguously assigned to a heptad repeat sequence. Linkers are frequently used in the field of protein engineering to interconnect different functional units, e.g., in the creation of single-chain variable fragment (scFv) constructs derived from antibody variable light (VL) and variable heavy (VH) chains. They are generally conformationally flexible in solution, and are suitably and predominantly composed of polar amino acid residue types. Typical (frequently used) amino acids in flexible linkers are serine and glycine. Less preferably, flexible linkers may also include alanine, threonine and proline. Thus, an intervening linker of the structure-stabilizing moiety is preferably flexible in conformation to

TABLE 7

COMPLEMENTARY HEPTAD REPEAT REGION SEQUENCES

| VIRUS | HR1 REGION SEQUENCE | HR2 REGION SEQUENCE |
|---|---|---|
| Synthetic | IEEIQKQIAAIQKQIAAIQKQIYRM [SEQ ID NO: 26] | IEEIQKQIAAIQKQIAAIQKQIYRM [SEQ ID NO: 27] |
| HIV GP160 | SGIVQQQNNLLRAIEAQQHLLQLTVWGIKQLQARILA [SEQ ID NO: 28] (GenPept dbjBAF31430.1) | HTTWMEWDREINNYTSLIHSLIEESQNQQEKNEQELLE [SEQ ID NO: 29] (GenPept dbjBAF31430.1) |
| RSV F | LHLEGEVNKIKSALLSTNKAVVSLGNGVSVLTSKVLDLK [SEQ ID NO: 30] (GenPept gbAHL84194.1] | FDASISQVNEKINQSLAFIRKSDELLHNVNAGKSTTN [SEQ ID NO: 31] (GenPept gbAHL84194.1] |
| hMPV F | IRLESEVTAIKNALKKTNEAVSTLGNGVRVLATAVRELK [SEQ ID NO: 32] (GenPept gbAAN52913.1] | FNVALDQVFESIENSQALVDQSNRILSSAEKGNTG [SEQ ID NO: 33] (GenPept gbAAN52913.1) |
| PIV F | KQARSDIEKLKEAIRDTNKAVQSVQSSIGNLIVAIKSVQ [SEQ ID NO:34] (GenPept gbAAB21447.1) | IELNKAKSDLEESKEWIRRSNQKLDSIGNWHQSSTT [SEQ ID NO: 35] (GenPept gbAAB21447.1] |
| MeV F | MLNSQAIDNLRASLETTNQAIEAIRQAGQEMILAVQGVQ [SEQ ID NO:36 dbjBAB60865.1] | LERLDVGTNLGNAIAKLEDAKELLESSDQILRSMKGLSST [SEQ ID NO: 37] (GenPept dbjBAB60865.1) |
| HeV F | MKNADNINKLKSSIESTNEAVVKLQETAEKTVYVLTALQ [SEQ ID NO: 38] (GenPept NP_047111.2) | ISSQISSMNQSLQQSKDYIKEAQKILDTVNPS [SEQ ID NO: 39] (GenPept NP_047111.2] |
| Inf A HA | ENGWEGMVDGWYGFRHQNSEGTGQAADLKSTQAAI [SEQ ID NO:40] (GenPept gbAEC23340.1) | RIQDLEKYVEDTKIDLWSYNAELVLALENQHTIDLTDSEM SKLFERTRR[SEQ ID NO: 41] (GenPept gbAEC23340.1) |
| Inf B HA | HGYTSHGAHGVAVAADLKSTQEAINKITKNLNYL [SEQ ID NO: 42] (GenPept gbAFH57854.1) | DEILELDEKVDDLRADTISSQIELAVLLSNEGIINSEDEH LLALERKLKKML[SEQ ID NO: 43] (GenPept gbAFH57854.1) |
| EBOV GP | GLRQLANETTQALQLFLRATTELRTFSILNRKAIDFL [SEQ ID NO: 44] (GenPept NP_066246.1) | HDWTKNITDKIDQIIHDFVDKTL [SEQ ID NO: 45] (GenPept NP_066246.1) |
| MARV GP | LANQTAKSLELLLRVTTEERTFSLINRHAIDFLLTRW [SEQ ID NO: 46](GenPept YP_001531156.1) | IGIEDLSKNISEQIDQI [SEQ ID NO: 47] (GenPept YP_001531156.1) |
| MERS S | ISASIGDIIQRLDVLEQDAQIDRLINGRLTTLNAFVAQ QLVRSESAALSAQLAKDKVNEG [SEQ ID NO: 48] (GenPept gbAHX00711.1) | GSGGNFGSLTQINTTLLDLTYEMLSLQQVVKALNESYIDLKELGNYTY [SEQ ID NO: 49] (GenPept gbAHX00711.1) |
| SARS S | ISSVLNDILSRLDKVEAEVQIDRLITGRLQSLQTYVTQ QLIRAAEIRASANLAATKMSEG [SEQ ID NO: 50] (GenPept gbAAR86788.1) | GSGGDVDLGDISGINASVVNIQKEIDRLNEVAKNLNESLIDLQELGK [SEQ ID NO: 51] (GenPept gbAAR86788.1) | ensure relaxed (unhindered) association of HR1 and HR2 as two-helix bundle that suitably adopts an α-helical coiled coil structure. Suitable linkers for use in the polypeptides envisaged herein will be clear to the skilled person, and may generally be any linker used in the art to link amino acid sequences, as long as the linkers are structurally flexible, in the sense that they permit, and suitably do not impair, assembly of the characteristic two-helix bundle structure of the structure-stabilizing moiety.

The skilled person will be able to determine the optimal linkers, optionally after performing a limited number of routine experiments. The intervening linker is suitably an amino acid sequence generally consisting of at least 1 amino acid residue and usually consisting of at least 2 amino acid residues, with a non-critical upper limit chosen for reasons of convenience being about 100 amino acid residues. In particular embodiments, the linker consists of about 1 to about 50 amino acid residues, or about 50 to about 100 amino acid residues, usually about 1 to about 40 amino acid residues, typically about 1 to about 30 amino acid residues. In non-limiting examples, the linker has about the same number of amino acids as the number of amino acids connecting complementary HRA and HRB regions of a Class I enveloped virus fusion protein. In particular, non-limiting embodiments, at least 50% of the amino acid residues of a linker sequence are selected from the group proline, glycine, and serine. In further non-limiting embodiments, at least 60%, such as at least 70%, such as for example 80% and more particularly 90% of the amino acid residues of a linker sequence are selected from the group proline, glycine, and serine. In other particular embodiments, the linker sequences essentially consist of polar amino acid residues; in such particular embodiments, at least 50%, such as at least 60%, such as for example 70% or 80% and more particularly 90% or up to 100% of the amino acid residues of a linker sequence are selected from the group consisting of glycine, serine, threonine, alanine, proline, histidine, asparagine, aspartic acid, glutamine, glutamic acid, lysine and arginine. In specific embodiments, linker sequences may include $[GGSG]_n GG$, $[GGGGS]_n$, $[GGGGG]_n$, $[GGGKGGGG]_n$, $[GGGNGGGG]_n$, $[GGGCGGGG]_n$, wherein n is an integer from 1 to 10, suitably 1 to 5, more suitably 1 to 3.

In specific embodiments in which the heptad repeat regions comprise, consist or consist essentially of complementary HRA and HRB regions, respectively, of a Class I enveloped virus fusion protein, the linker comprises, consists or consists essentially of an intervening naturally-occurring amino acid sequence, which connects the HRA and HRB regions. The intervening sequence can be full-length, or about full-length or can comprise, consist or consist essentially of one or more portions of a full-length intervening naturally-occurring amino acid sequence. In other embodiments, the linker lacks a naturally-occurring amino acid sequence interposed between the HRA and HRB regions of a wild-type Class I enveloped virus fusion protein. In any of the above embodiments, the linker may comprise one or more non-naturally-occurring amino acid sequences.

In addition to spacing the heptad repeat regions of the structure-stabilizing moiety and preferably introducing structural flexibility to facilitate anti-parallel association of those regions, the linker may comprise one or more ancillary functionalities. For example, the linker may comprise a purification moiety that facilitates purification of the chimeric polypeptide and/or at least one immune-modulating moiety that modulates an immune response to the chimeric polypeptide.

Purification moieties typically comprise a stretch of amino acids that enables recovery of the chimeric polypeptide through affinity binding. Numerous purification moieties or 'tags' are known in the art, illustrative examples of which include biotin carboxyl carrier protein-tag (BCCP-tag), Myc-tag (c-myc-tag), Calmodulin-tag, FLAG-tag, HA-tag, His-tag (Hexahistidine-tag, His6, 6H), Maltose binding protein-tag (MBP-tag), Nus-tag, Chitin-binding protein-tag (CBP-tag) Glutathione-S-transferase-tag (GST-tag), Green fluorescent protein-tag (GFP-tag), Polyglutamate-tag, Amyloid beta-tag, Thioredoxin-tag, S-tag, Softag 1, Softag 3, Strep-tag, Streptavidin-binding peptide-tag (SBP-tag), biotin-tag, streptavidin-tag and V5-tag.

Immune-modulating moieties can be introduced into the linker to modulate the immune response elicited by the chimeric polypeptide or complex thereof. Non-limiting examples of such moieties include immune-silencing or suppressing moieties as described for example above, antigenic moieties, including antigenic moieties derived from pathogenic organisms, or other disease associated antigenic moieties such as cancer or tumor associated antigens. Exemplary pathogenic organisms include, but are not limited to, viruses, bacteria, fungi parasites, algae and protozoa and amoebae. In specific embodiments, the antigenic moieties are derived from antigens of pathogenic viruses. Illustrative viruses responsible for diseases including, but not limited to, measles, mumps, rubella, poliomyelitis, hepatitis A, B (e.g., GenBank Accession No. E02707), and C (e.g., GenBank Accession No. E06890), as well as other hepatitis viruses, influenza, adenovirus (e.g., types 4 and 7), rabies (e.g., GenBank Accession No. M34678), yellow fever, Epstein-Barr virus and other herpesviruses such as papillomavirus, Ebola virus, influenza virus, Japanese encephalitis (e.g., GenBank Accession No. E07883), dengue (e.g., GenBank Accession No. M24444), hantavirus, Sendai virus, respiratory syncytial virus, orthomyxoviruses, vesicular stomatitis virus, visna virus, cytomegalovirus and human immunodeficiency virus (HIV) (e.g., GenBank Accession No. U18552). Any suitable antigen derived from such viruses are useful in the practice of the present invention. For example, illustrative retroviral antigens derived from HIV include, but are not limited to, antigens such as gene products of the gag, pol, and env genes, the Nef protein, reverse transcriptase, and other HIV components. Illustrative examples of hepatitis viral antigens include, but are not limited to, antigens such as the S, M, and L proteins of hepatitis B virus, the pre-S antigen of hepatitis B virus, and other hepatitis, e.g., hepatitis A, B, and C. Illustrative examples of influenza viral antigens include; but are not limited to, antigens such as hemagglutinin and neuraminidase and other influenza viral components. Illustrative examples of measles viral antigens include, but are not limited to, antigens such as the measles virus fusion protein and other measles virus components. Illustrative examples of rubella viral antigens include, but are not limited to, antigens such as proteins E1 and E2 and other rubella virus components; rotaviral antigens such as VP7sc and other rotaviral components. Illustrative examples of Cytomegaloviral antigens include, but are not limited to, antigens such as envelope glycoprotein B and other Cytomegaloviral antigen components. Non-limiting examples of respiratory syncytial viral antigens include antigens such as the RSV fusion protein, the M2 protein and other respiratory syncytial viral antigen components. Illustrative examples of herpes simplex viral antigens include, but are not limited to, antigens such as immediate early proteins, glycoprotein D, and other herpes simplex viral antigen components. Non-limiting examples of varicella zoster viral antigens include antigens such as 9PI, gpII, and other varicella zoster viral antigen components. Non-limiting examples of Japanese encephalitis viral antigens include antigens such as proteins E, M-E, M-E-NS 1, NS 1, NS 1-NS2A, 80% E, and other Japanese encephalitis viral antigen components. Representative examples of rabies viral antigens include, but are not limited to, antigens such as rabies glycoprotein, rabies nucleoprotein and other rabies viral antigen components. Illustrative examples of papillomavirus antigens include, but are not limited to, the L1 and L2 capsid proteins as well as the E6/E7 antigens associated with cervical cancers, See Fundamental Virology, Second Edition, eds. Fields, B. N. and Knipe, D. M., 1991, Raven Press, New York, for additional examples of viral antigens. In particular embodiments, the viral antigen is an antigen of an enveloped virus to which the ectodomain polypeptide corresponds. In other embodiments, the viral antigen is an antigen of a different enveloped virus to which the ectodomain polypeptide corresponds.

In some embodiments, one or more cancer- or tumor-associated antigens are inserted into the linker. Such antigens include, but are not limited to, MAGE-2, MAGE-3, MUC-1, MUC-2, HER-2, high molecular weight melanoma-associated antigen MAA, GD2, carcinoembryonic antigen (CEA), TAG-72, ovarian-associated antigens OV-TL3 and MOV 18, TUAN, alpha-feto protein (AFP), OFP, CA-125, CA-50, CA-19-9, renal tumor-associated antigen G250, EGP-40 (also known as EpCAM), S100 (malignant melanoma-associated antigen), p53, prostate tumor-associated antigens (e.g., PSA and PSMA), p21ras, Her2/neu, EGFR, EpCAM, VEGFR, FGFR, MUC-I, CA 125, CEA, MAGE, CD20, CD19, CD40, CD33, A3, antigen specific to A33 antibodies, BrE3 antigen, CD1, CD1a, CD5, CD8, CD14, CD15, CD16, CD21, CD22, CD23, CD30, CD33, CD37, CD38, CD40, CD45, CD46, CD52, CD54, CD74, CD79a, CD126, CD138, CD154, B7, Ia, Ii, HMI.24, HLA-DR (e.g., HLA-DR10), NCA95, NCA90, HCG and sub-units, CEA (CEACAM5), CEACAM-6, CSAp, EGP-I, EGP-2, Ba 733, KC4 antigen, KS-I antigen, KS1-4, Le-Y, MUC2, MUC3, MUC4, PIGF, ED-B fibronectin, NCA 66a-d, PAM-4 antigen, PSA, PSMA, RS5, SIOO, TAG-72, TIOI, TAG TRAIL-RI, TRAIL-R2, p53, tenascin, insulin growth factor-1 (IGF-I), Tn antigen etc.

The antigenic moiety or moieties included in the linker may correspond to full-length antigens or part antigens. When part antigens are employed, the part antigens may comprise one or more epitopes of an antigen of interest, including B cell epitopes and/or T cell epitopes (e.g., cytotoxic T lymphocyte (CTL) epitopes and/or T helper (Th) epitopes). Epitopes of numerous antigens are known in the literature or can be determined using routine techniques known to persons of skill in the art. In other embodiments the linker may include another cell targeting moiety which can provide delivery to a specific cell type within the immunized individual. Cell populations of interest include, but are not limited to, B-cells, Microfold cells and antigen-presenting cells (APC). In the later example the targeting moiety facilitates enhanced recognition of the chimeric polypeptide or complex thereof to an APC such as a dendritic cell or macrophage. Such targeting sequences can enhance APC presentation of epitopes of an associated ectodomain polypeptide, which can in turn augment the resultant immune response, including intensification or broadening the specificity of either or both of antibody and cellular immune responses to the ectodomain polypeptide. Non-limiting examples of APC-targeting moieties include ligands that bind to APC surface receptors such as, but not limited to, mannose-specific lectin (mannose receptor), IgG Fc receptors, DC-SIGN, BDCA3 (CD141), 33D1, SIGLEC-H, DCIR, CD11c, heat shock protein receptors and scavenger receptors. In particular embodiments, the APC-targeting moiety is a dendritic cell targeting moiety, which comprises, consists or consists essentially of the sequence FYPSYH-STPQRP (Uriel, et al., *J. Immunol* 2004 172: 7425-7431) or NWYLPWLGTNDW (Sioud, et al., *FASEB J* 2013 27(8): 3272-83).

2.2 Enveloped Virus Fusion Proteins and Ectodomain Polypeptides

The molecular clamping strategy of the present invention is useful for stabilizing a range of ectodomain polypeptides whose wild-type counterparts assemble into trimers in their pre-fusion forms, including Class I and Class III fusion proteins. Non-limiting Class I fusion proteins include the fusion proteins of orthomyxoviruses (e.g., the HA proteins of Inf A, Inf B and Inf C), paramyxoviruses (e.g., the F and proteins of MeV, RPV, CDV, RSV, HMPV, PIV, MuV, HeV, NiV and NDV), retroviruses (e.g., the envelope glycoproteins of HTLV-1, HTLV-2, HTLV-3, HIV-1, HIV-2), filoviruses (e.g., the glycoproteins of EBOV, ZEBOV, REBOV, SEBOV and MARV), arenaviruses (e.g., the glycoproteins and stable signal peptides (SSP) of LASV, LCMV and JUNV), and coronaviruses (e.g., the S proteins of HCoV, HToV, SARS-CoV and MERS-CoV). Representative Class III fusion proteins include the fusion proteins of rhabdoviruses (e.g., the glycoproteins (G) of Rabies virus (RABV), Australian Bat Lyssavirus (ABLV), Bovine ephemeral fever virus (BEFV) and Vesicular stomatitis virus (VSV)) and herpesviruses (e.g., the glycoproteins (gB, gD, gH/L) of Human herpes virus type 1 (HHV-1; also known as Herpes simplex virus type 1 (HSV-1)), HHV-2 (also known as HSV-2), HHV-3 (also known as Varicella zoster virus (VZV)), HHV-4 (also known as Epstein Barr virus (EBV)) and HHV-5 (also known as Cytomegalovirus (CMV)).

The ectodomain polypeptide may comprise or consist of a full-length precursor ectodomain polypeptide or a portion thereof. In some embodiments, the ectodomain polypeptide lacks any one or more of an endogenous signal peptide, an endogenous head portion of an ectodomain, an endogenous stem portion of an ectodomain, an endogenous mucin-like domain, an endogenous membrane proximal external region (MPER) and an endogenous fusion peptide. Alternatively, or in addition, one or more endogenous proteolytic cleavage sites (e.g., one or more furin cleavage sites) of a wild-type or reference fusion protein may be altered or deleted to render the ectodomain polypeptide less susceptible to proteolytic cleavage by a protease (e.g., a cellular protease such as furin).

The ectodomain polypeptides of the invention can be constructed with knowledge of the locations of various structural and functional moieties or domains that are present in a full-length enveloped virus precursor fusion protein. Non-limiting examples of such precursor proteins and their associated domains are discussed below with reference to the construction of illustrative ectodomain polypeptide embodiments.

2.2.1 Inf A HA

An exemplary Inf A HA precursor has the following amino acid sequence:

[SEQ ID NO: 52]
MKTIIALSYIFCLALGQDLPGNDNSTATLCLGHHAVPNGTLVKTITDD
QIEVTNATELVQSSSTGKICNNPHRILDGIDCTLIDALLGDPHCDVFQ
NETWDLFVERSKAFSNCYPYDVPDYASLRSLVASSGTLEFITEGFTWT
GVTQNGGSNACKRGPGSGFFSRLNWLTKSGSTYPVLNVTMPNNDNFDK
LYIWGIHHPSTNQEQTSLYVQASGRVIVSTRRSQQTIIPNIGSRPWVR
GLSSRISTYWTIVKPGDVLVINSNGNLIAPRGYFKMRTGKSSIMRSDA
PIDTCISECITPNGSIPNDKPFQNVNKITYGACPKYVKQNTLKLATGM
RNVPEKQTRGLFGAIAGFIENGWEGMIDGWYGFRHQNSEGTGQAADLK
STQAAIDQINGKLNRVIEKTNEKFHQIEKEFSEVEGRIQDLEKYVEDT
KIDLWSYNAELLVALENQHTIDLTDSEMNKLFEKTRRQLRENAEEMGN
GCFKIYHKCDNACIESIRNGTYDHDVYRDEALNNRFQIKGVELKSGYK
DWILWISFAISCFLLCVVLLGFIMWACQRGNIRCNICI
(GenPept gbAEC23340.1).

This sequence comprises the following domains/moieties:
SP=1-16
Ectodomain=17-529
Furin cleavage sites=345-346
FP=346-355
HRA region=356-390
HRB region=421-470
MPER=470-529
TM=530-553
C=534-556
Head region=51-328, 403-444,
Stem region=17-58, 327-401, 442-509.

Non-limiting examples of Inf A HA ectodomain polypeptides include:

Ectodomain 1-529:
[SEQ ID NO: 53]
MKTIIAFSCILCLIFAQKLPGSDNSMATLCLGHHAVPNGTLVKTITDD
QIEVTNATELVQSSSTGRICNSPHQILDGKNCTLIDALLGDPHCDDFQ
NKEWDLFVERSTAYSNCYPYYVPDYATLRSLVASSGNLEFTQESFNWT
GVAQDGSSYACRRGSVNSFFSRLNWLYNLNYKYPEQNVTMPNNDKFDK
LYIWGVHHPGTDKDQTNLYVQASGRVIVSTKRSQQTVIPNIGSRPWVR
GVSSIISIYWTIVKPGDILLINSTGNLIAPRGYFKIQSGKSSIMRSDA
HIDECNSECITPNGSIPNDKPFQNVNKITYGACPRYVKQNTLKLATGM
RNVPEKQTRGIFGAIAGFIENGWEGMVDGWYGFRHQNSEGTGQAADLK
STQAAINQITGKLNRVIKKTNEKFHQIEKEFSEVEGRIQDLEKYVEDT
KIDLWSYNAELLVALENQHTIDLTDSEMSKLFERTRRQLRENAEDMGN
GCFKIYHKCDNACIGSIRNGTYDHDIYRNEALNNRFQIKGVQLKSGYK
D
(GenPept gbAEC23340.1).

Ectodomain minus SP 18-529:
[SEQ ID NO: 54]
KLPGSDNSMATLCLGHHAVPNGTLVKTITDDQIEVTNATELVQSSSTG
RICNSPHQILDGKNCTLIDALLGDPHCDDFQNKEWDLFVERSTAYSNC
YPYYVPDYATLRSLVASSGNLEFTQESFNWTGVAQDGSSYACRRGSVN -continued SFFSRLNWLYNLNYKYPEQNVTMPNNDKFDKLYIWGVHHPGTDKDQTN
LYVQASGRVIVSTKRSQQTVIPNIGSRPWVRGVSSIISIYWTIVKPGD
ILLINSTGNLIAPRGYFKIQSGKSSIMRSDAHIDECNSECITPNGSIP
NDKPFQNVNKITYGACPRYVKQNTLKLATGMRNVPEKQTRGIFGAIAG
FIENGWEGMVDGWYGFRHQNSEGTGQAADLKSTQAAINQITGKLNRVI
KKTNEKFHQIEKEFSEVEGRIQDLEKYVEDTKIDLWSYNAELLVALEN
QHTIDLTDSEMSKLFERTRRQLRENAEDMGNGCFKIYHKCDNACIGSI
RNGTYDHDIYRNEALNNRFQIKGVQLKSGYKD
(GenPept gbAEC23340.1).

Ectodomain minus SP minus, MPER18-469:
[SEQ ID NO: 55]
KLPGSDNSMATLCLGHHAVPNGTLVKTITDDQIEVTNATELVQSSSTG
RICNSPHQILDGKNCTLIDALLGDPHCDDFQNKEWDLFVERSTAYSNC
YPYYVPDYATLRSLVASSGNLEFTQESFNWTGVAQDGSSYACRRGSVN
SFFSRLNWLYNLNYKYPEQNVTMPNNDKFDKLYIWGVHHPGTDKDQTN
LYVQASGRVIVSTKRSQQTVIPNIGSRPWVRGVSSIISIYWTIVKPGD
ILLINSTGNLIAPRGYFKIQSGKSSIMRSDAHIDECNSECITPNGSIP
NDKPFQNVNKITYGACPRYVKQNTLKLATGMRNVPEKQTRGIFGAIAG
FIENGWEGMVDGWYGFRHQNSEGTGQAADLKSTQAAINQITGKLNRVI
KKTNEKFHQIEKEFSEVEGRIQDLEKYVEDTKIDLWSYNAELLVALEN
QHTIDLTDSEMSKLFERTRR
(GenPept gbAEC23340.1).

Ectodomain 18-341, 346-529 plus altered furin cleavage sites:
[SEQ ID NO: 56]
KLPGSDNSMATLCLGHHAVPNGTLVKTITDDQIEVTNATELVQSSSTG
RICNSPHQILDGKNCTLIDALLGDPHCDDFQNKEWDLFVERSTAYSNC
YPYYVPDYATLRSLVASSGNLEFTQESFNWTGVAQDGSSYACRRGSVN
SFFSRLNWLYNLNYKYPEQNVTMPNNDKFDKLYIWGVHHPGTDKDQTN
LYVQASGRVIVSTKRSQQTVIPNIGSRPWVRGVSSIISIYWTIVKPGD
ILLINSTGNLIAPRGYFKIQSGKSSIMRSDAHIDECNSECITPNGSIP
NDKPFQNVNKITYGACPRYVKQNTLKLATGMRNVPE*RRRKKR*GIFGAI
AGFIENGWEGMVDGWYGFRHQNSEGTGQAADLKSTQAAINQITGKLNR
VIKKTNEKFHQIEKEFSEVEGRIQDLEKYVEDTKIDLWSYNAELLVAL
ENQHTIDLTDSEMSKLFERTRRQLRENAEDMGNGCFKIYHKCDNACIG
SIRNGTYDHDIYRNEALNNRFQIKGVQLKSGYKD
(GenPept gbAEC23340.1).

Stem domain 1-58, 327-401, 442-509 plus linker regions:
[SEQ ID NO: 57]
MKTIIALSYILCLVFAQKLPGNDNSTATLCLGHHAVPNGTIVKTITND
QIEVTNATELGFGQNTLKLATGMRNVPEKQTRGIFGAIAGFIENGWEG
MLDGWYGFRHQNSEGRGQAADLKSTQAAIDQINGMLNRLI*GSGGSG*EL
LVALLNQHTIDLTDSEMNKLFEKTKKQLRENAEDMGNGCFKIYHKCDN
ACIGSIRNGTYDHDVYRDEALNNRFQIKGVELKSGYKD
(GenPept gbAEC23340.1).

Head domain 1-18, 51-328, 403-444 plus linker regions:
[SEQ ID NO: 58]
MKTIIALSYILCLVFAQKEVTNATELVQNSSTGGICDSPHQILDGENC

TLIDALLGDPQCDGFQNKKWDLFVERSKAYSNCYPYDVPDYASLRSLV

ASSGTLEFNNESFNWTGVTQNGTSSACKRGSNNSFFSRLNWLTHSKFK

YPALNVTMPNNEEFDKLYIWGVHHPGTDNDQIFLYAQASGRITVSTKR

SQQTVIPNIGSRPRVRNIPSRISIYWTIVKPGDILLINSTGNLIAPRG

YFKIRSGKSSIMRSDAPIGKCNSECITPNGSIPNDKPFQNVNRITYGA

CPRYVKQN*GSGGSG*KTNEKFHQIEKEFSEVEGRIQDLEKYVEDTKIDL

WSYNAELL
(GenPept gbAEC23340.1).

2.2.2 Inf B HA
A representative Inf B HA precursor has the following amino acid sequence:
[SEQ ID NO: 59]
MKAIIVLLMVVTSNADRICTGITSSNSPHVVKTATQGEVNVTGVIPLT

TTPTKSHFANLKGTQTRGKLCPNCFNCTDLDVALGRPKCMGNTPSAKV

SILHEVKPATSGCFPIMHDRTKIRQLPNLLRGYENIRLSTSNVINTET

APGGPYKVGTSGSCPNVANGNGFFNTMAWVIPKDNNKTAINPVTVEVP

YICSEGEDQITVWGFHSDDKTQMERLYGDSNPQKFTSSANGVTTHYVS

QIGGFPNQTEDEGLKQSGRIVVDYMVQKPGKTGTIVYQRGILLPQKVW

CASGRSKVIKGSLPLIGEADCLHEKYGGLNKSKPYYTGEHAKAIGNCP

IWVKTPLKLANGTKYRPPAKLLKERGFFGAIAGFLEGGWEGMIAGWHG

YTSHGAHGVAVAADLKSTQEAINKITKNLNYLSELEVKNLQRLSGAMN

ELHDERELDEKVDDLRADTISSQIELAVLLSNEGIINSEDEHLLALER

KLKKMLGPSAVEIGNGCFETKHKCNQTCLDRIAAGTFNAGDFSLPTFD

SLNITAASLNDDGLDNHTILLYYSTAASSLAVTLMIAIFIVYMVSRDN

VSCSICL
(GenPept gbAFH57854.1].

This sequence comprises the following domains/moieties:
SP=1-16
Ectodomain=17-547
Furin cleavage sites=361-362
FP=362-382
HRA region=383-416
HRB region=436-487
MPER=488-547
TM=548-573
C=574-584
Head region=48-344, 418-456
Stem region=17-47, 345-417, 457-547

Non-limiting examples of Inf B HA ectodomain polypeptides include:

Ectodomain 1-547:
[SEQ ID NO: 60]
MKAIIVLLMVVTSNADRICTGITSSNSPHVVKTATQGEVNVTGVIPLT

TTPTKSHFANLKGTQTRGKLCPNCFNCTDLDVALGRPKCMGNTPSAKV

SILHEVKPATSGCFPIMHDRTKIRQLPNLLRGYENIRLSTSNVINTET

APGGPYKVGTSGSCPNVANGNGFFNTMAWVIPKDNNKTAINPVTVEVP

YICSEGEDQITVWGFHSDDKTQMERLYGDSNPQKFTSSANGVTTHYVS

QIGGFPNQTEDEGLKQSGRIVVDYMVQKPGKTGTIVYQRGILLPQKVW

CASGRSKVIKGSLPLIGEADCLHEKYGGLNKSKPYYTGEHAKAIGNCP

IWVKTPLKLANGTKYRPPAKLLKERGFFGAIAGFLEGGWEGMIAGWHG

YTSHGAHGVAVAADLKSTQEAINKITKNLNYLSELEVKNLQRLSGAMN

ELHDEILELDEKVDDLRADTISSQIELAVLLSNEGIINSEDEHLLALE

RKLKKMLGPSAVEIGNGCFETKHKCNQTCLDRIAAGTFNAGDFSLPTF

DSLNITAASLNDDGLDNHT
(GenPept gbAFH57854.1).

Ectodomain minus SP 17-547:
[SEQ ID NO: 61]
RICTGITSSNSPHVVKTATQGEVNVTGVIPLTTTPTKSHFANLKGTQT

RGKLCPNCFNCTDLDVALGRPKCMGNTPSAKVSILHEVKPATSGCFPI

MHDRTKIRQLPNLLRGYENIRLSTSNVINTETAPGGPYKVGTSGSCPN

VANGNGFFNTMAWVIPKDNNKTAINPVTVEVPYICSEGEDQITVWGFH

SDDKTQMERLYGDSNPQKFTSSANGVTTHYVSQIGGFPNQTEDEGLKQ

SGRIVVDYMVQKPGKTGTIVYQRGILLPQKVWCASGRSKVIKGSLPLI

GEADCLHEKYGGLNKSKPYYTGEHAKAIGNCPIWVKTPLKLANGTKYR

PPAKLLKERGFFGAIAGFLEGGWEGMIAGWHGYTSHGAHGVAVAADLK

STQEAINKITKNLNYLSELEVKNLQRLSGAMNELHDEILELDEKVDDL

RADTISSQIELAVLLSNEGIINSEDEHLLALERKLKKMLGPSAVEIGN

GCFETKHKCNQTCLDRIAAGTFNAGDFSLPTFDSLNITAASLNDDGLD

NHT
(GenPept gbAFH57854.1).

Ectodomain minus SP, minus MPER 17-487:
[SEQ ID NO: 62]
RICTGITSSNSPHVVKTATQGEVNVTGVIPLTTTPTKSHFANLKGTQT

RGKLCPNCFNCTDLDVALGRPKCMGNTPSAKVSILHEVKPATSGCFPI

MHDRTKIRQLPNLLRGYENIRLSTSNVINTETAPGGPYKVGTSGSCPN

VANGNGFFNTMAWVIPKDNNKTAINPVTVEVPYICSEGEDQITVWGFH

SDDKTQMERLYGDSNPQKFTSSANGVTTHYVSQIGGFPNQTEDEGLKQ

SGRIVVDYMVQKPGKTGTIVYQRGILLPQKVWCASGRSKVIKGSLPLI

GEADCLHEKYGGLNKSKPYYTGEHAKAIGNCPIWVKTPLKLANGTKYR

PPAKLLKERGFFGAIAGFLEGGWEGMIAGWHGYTSHGAHGVAVAADLK

STQEAINKITKNLNYLSELEVKNLQRLSGAMNELHDEILELDEKVDDL

RADTISSQIELAVLLSNEGIINSEDEHLLALERKLKKML
(GenPept gbAFH57854.1).

Ectodomain minus SP plus altered furin cleavage sites 17-355, 362-547:
[SEQ ID NO: 63]
RICTGITSSNSPHVVKTATQGEVNVTGVIPLTTTPTKSHFANLKGTQT

RGKLCPNCFNCTDLDVALGRPKCMGNTPSAKVSILHEVKPATSGCFPI

MHDRTKIRQLPNLLRGYENIRLSTSNVINTETAPGGPYKVGTSGSCPN

VANGNGFFNTMAWVIPKDNNKTAINPVTVEVPYICSEGEDQITVWGFH

SDDKTQMERLYGDSNPQKFTSSANGVTTHYVSQIGGFPNQTEDEGLKQ

-continued
SGRIVVDYMVQKPGKTGTIVYQRGILLPQKVWCASGRSKVIKGSLPLI
GEADCLHEKYGGLNKSPYYTGEHAKAIGNCPIWVKTPLKLANGTKYR
PPAR*RRKK*RAGFFGAIAGFLEGGWEGMIAGWHGYTSHGAHGVAVAADL
KSTQEAINKITKNLNYLSELEVKNLQRLSGAMNELHDEILELDEKVDD
LRADTISSQIELAVLLSNEGIINSEDEHLLALERKLKKMLGPSAVEIG
NGCFETKHKCNQTCLDRIAAGTFNAGDFSLPTFDSLNITAASLNDDGL
DNHT
(GenPept gbAFH57854.1).

Stem domain 1-47, 345-417, 457-547 plus linker
regions:
[SEQ ID NO: 64]
MKAIIVLLMVVTSNADRICTGITSSNSPHVVKTATQGEVNVTGVIPL*G*
*SG*LANGTKYRPPAKLLKERGFFGAIAGFLEGGWEGMIAGWHGYTSHGA
HGVAVAADLKSTQEAINKITKNLNYLS*GSGGSG*IELAVLLSNEGIINS
EDEHLLALERKLKKMLGPSAVEIGNGCFETKHKCNQTCLDRIAAGTFN
AGDFSLPTFDSLNITAASLNDDGLDNHT
(GenPept gbAFH57854.1).

Head domain 1-17, 48-344, 418-456 plus linker
regions:
[SEQ ID NO: 65]
MKAIIVLLMVVTSNADRTTTPTKSHFANLKGTQTRGKLCPNCFNCTDL
DVALGRPKCMGNTPSAKVSILHEVKPATSGCFPIMHDRTKIRQLPNLL
RGYENIRLSTSNVINTETAPGGPYKVGTSGSCPNVANGNGFFNTMAWV
IPKDNNKTAINPVTVEVPYICSEGEDQITVWGFHSDDKTQMERLYGDS
NPQKFTSSANGVTTHYVSQIGGFPNQTEDEGLKQSGRIVVDYMVQKPG
KTGTIVYQRGILLPQKVWCASGRSKVIKGSLPLIGEADCLHEKYGGLN
KSKPYYTGEHAKAIGNCPIWVKTPLK*GSGGSG*ELEVKNLQRLSGAMNE
LHDEILELDEKVDDLRADTISSQ
(GenPept gbAFH57854.1).

2.2.3 RSV F
A non-limiting RSF F precursor has the following
amino acid sequence:
[SEQ ID NO: 66]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCEIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGKSTTNIMIT
TIIIVIIVILLSLIAVGLLLYCKARSTPVTLSKDQLSGINNIAFSN
(GenPept gbAHL84194.1).

This sequence comprises the following domains/moieties:
SP=1-23
Ectodomain=24-524
Furin cleavage sites=109-110, 136-137
FP=137-163
HRA region=164-196
HRB region=488-524
TM=525-548
C=549-574
D25 interaction domain=61-97, 193-240

Non-limiting examples of RSV F ectodomain polypeptides include:
Ectodomain 1-524:

[SEQ ID NO: 67]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCEIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGKSTTN
(GenPept gbAHL84194.1).

Ectodomain of RSV F (1-520):
[SEQ ID NO: 146]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCEIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGK.

Ectodomain minus SP 24-524:
[SEQ ID NO: 68]
SGQNITEEFYQSTCSAVSKGYLSALRTGWYTSVITIELSNIKKNKCNG
TDAKVKLIKQELDKYKNAVTELQLLMQSTQATNNRARRELPRFMNYTL
NNAKKTNVTLSKKRKRRFLGFLLGVGSAIASGVAVSKVLHLEGEVNKI
KSALLSTNKAVVSLSNGVSVLTSKVLDLKNYIDKQLLPIVNKQSCSIS
NIETVIEFQQKNNRLLEITREFSVNAGVTTPVSTYMLTNSELLSLIND
MPITNDQKKLMSNNVQIVRQQSYSIMSIIKEEVLAYVVQLPLYGVIDT
PCWKLHTSPLCTTNTKEGSNICLTRTDRGWYCDNAGSVSFFPQAETCK -continued

VQSNRVFCDTMNSLTLPSEVNLCNVDIFNPKYDCEIMTSKTDVSSSVI

TSLGAIVSCYGKTKCTASNKNRGIIKTFSNGCDYVSNKGVDTVSVGNT

LYYVNKQEGKSLYVKGEPIINFYDPLVFPSDEFDASISQVNEKINQSL

AFIRKSDELLHNVNAGKSTTN
(GenPept gbAHL84194.1).

Ectodomain minus SP plus altered furin cleavage
sites 24-524:
[SEQ ID NO: 69]
SGQNITEEFYQSTCSAVSKGYLSALRTGWYTSVITIELSNIKKNKCNG

TDAKVKLIKQELDKYKNAVTELQLLMQSTQATNN*NANN*ELPRFMNYTL

NNAKKTNVTLS*NNNNNN*FLGFLLGVGSAIASGVAVSKVLHLEGEVNKI

KSALLSTNKAVVSLSNGVSVLTSKVLDLKNYIDKQLLPIVNKQSCSIS

NIETVIEFQQKNNRLLEITREFSVNAGVTTPVSTYMLTNSELLSLIND

MPITNDQKKLMSNNVQIVRQQSYSIMSIIKEEVLAYVVQLPLYGVIDT

PCWKLHTSPLCTTNTKEGSNICLTRTDRGWYCDNAGSVSFFPQAETCK

VQSNRVFCDTMNSLTLPSEVNLCNVDIFNPKYDCEIMTSKTDVSSSVI

TSLGAIVSCYGKTKCTASNKNRGIIKTFSNGCDYVSNKGVDTVSVGNT

LYYVNKQEGKSLYVKGEPIINFYDPLVFPSDEFDASISQVNEKINQSL

AFIRKSDELLHNVNAGKSTTN
(GenPept gbAHL84194.1).

D25 interaction domain 61-97, 193-240 plus
linker regions:
[SEQ ID NO: 70]
LSNIKKNKCNGTDAKVKLIKQELDKYKNAVTELQLLMGGLDLKNYIDK QLLPIVNKQSCSISNIETVIEFQQKNNRLLEITREFSVN
(GenPept gbAHL84194.1).

2.2.4 hMPV F
An illustrative hMPV F precursor has the
following amino acid sequence:
[SEQ ID NO: 71]
MSWKVVIIFSLLITPQHGLKESYLEESCSTITEGYLSVLRTGWYTNVF

TLEVGDVENLTCADGPSLIKTELDLTKSALRELRTVSADQLAREEQIE

NPRQSRFVLGAIALGVATAAAVTAGVAIAKTIRLESEVTAIKNALKKT

NEAVSTLGNGVRVLATAVRELKDFVSKNLTRAINKNKCDIADLKMAVS

FSQFNRRFLNVVRQFSDNAGITPAISLDLMTDAELARAVSNMPTSAGQ

IKLMLENRAMVRRKGFGILIGVYGSSVIYMVQLPIFGVIDTPCWIVKA

APSCSEKKGNYACLLREDQGWYCQNAGSTVYYPNEKDCETRGDHVFCD

TAAGINVAEQSKECNINISTTNYPCKVSTGRHPISMVALSPLGALVAC

YKGVSCSIGSNRVGIIKQLNKGCSYITNQDADTVTIDNTVYQLSKVEG

EQHVIKGRPVSSSFDPVKFPEDQFNVALDQVFESIENSQALVDQSNRI

LSSAEKGNTGFIIVIILIAVLGSTMILVSVFIIIKKTKKPTGAPPELS

GVTNNGFIPHN
(GenPept gbAAN52913.1).

This sequence comprises the following domains/moieties:
SP=1-19
Ectodomain=1-490
Furin cleavage sites=102-103
FP=103-125
HRA region=126-169
HRB region=456-490
TM=491-514
C=515-539

Non-limiting examples of hMPV F ectodomain polypeptides include:

Ectodomain 1-490:
[SEQ ID NO: 72]
MSWKVVIIFSLLITPQHGLKESYLEESCSTITEGYLSVLRTGWYTNVF

TLEVGDVENLTCADGPSLIKTELDLTKSALRELRTVSADQLAREEQIE

NPRQSRFVLGAIALGVATAAAVTAGVAIAKTIRLESEVTAIKNALKKT

NEAVSTLGNGVRVLATAVRELKDFVSKNLTRAINKNKCDIADLKMAVS

FSQFNRRFLNVVRQFSDNAGITPAISLDLMTDAELARAVSNMPTSAGQ

IKLMLENRAMVRRKGFGILIGVYGSSVIYMVQLPIFGVIDTPCWIVKA

APSCSEKKGNYACLLREDQGWYCQNAGSTVYYPNEKDCETRGDHVFCD

TAAGINVAEQSKECNINISTTNYPCKVSTGRHPISMVALSPLGALVAC

YKGVSCSIGSNRVGIIKQLNKGCSYITNQDADTVTIDNTVYQLSKVEG

EQHVIKGRPVSSSFDPVKFPEDQFNVALDQVFESIENSQALVDQSNRI

LSSAEKGNTG
(GenPept gbAAN52913.1).

Ectodomain minus SP 20-490:
[SEQ ID NO: 73]
KESYLEESCSTITEGYLSVLRTGWYTNVFTLEVGDVENLTCADGPSLI

KTELDLTKSALRELRTVSADQLAREEQIENPRQSRFVLGAIALGVATA

AAVTAGVAIAKTIRLESEVTAIKNALKKTNEAVSTLGNGVRVLATAVR

ELKDFVSKNLTRAINKNKCDIADLKMAVSFSQFNRRFLNVVRQFSDNA

GITPAISLDLMTDAELARAVSNMPTSAGQIKLMLENRAMVRRKGFGIL

IGVYGSSVIYMVQLPIFGVIDTPCWIVKAAPSCSEKKGNYACLLREDQ

GWYCQNAGSTVYYPNEKDCETRGDHVFCDTAAGINVAEQSKECNINIS

TTNYPCKVSTGRHPISMVALSPLGALVACYKGVSCSIGSNRVGIIKQL

NKGCSYITNQDADTVTIDNTVYQLSKVEGEQHVIKGRPVSSSFDPVKF

PEDQFNVALDQVFESIENSQALVDQSNRILSSAEKGNTG
(GenPept gbAAN52913.1).

Ectodomain minus SP plus altered furin cleavage
sites 20-490:
[SEQ ID NO: 74]
KESYLEESCSTITEGYLSVLRTGWYTNVFTLEVGDVENLTCADGPSLI

KTELDLTKSALRELRTVSADQLAREEQIENP*NQSNF*VLGAIALGVATA

AAVTAGVAIAKTIRLESEVTAIKNALKKTNEAVSTLGNGVRVLATAVR

ELKDFVSKNLTRAINKNKCDIADLKMAVSFSQFNRRFLNVVRQFSDNA

GITPAISLDLMTDAELARAVSNMPTSAGQIKLMLENRAMVRRKGFGIL

IGVYGSSVIYMVQLPIFGVIDTPCWIVKAAPSCSEKKGNYACLLREDQ

GWYCQNAGSTVYYPNEKDCETRGDHVFCDTAAGINVAEQSKECNINIS

TTNYPCKVSTGRHPISMVALSPLGALVACYKGVSCSIGSNRVGIIKQL

NKGCSYITNQDADTVTIDNTVYQLSKVEGEQHVIKGRPVSSSFDPVKF

PEDQFNVALDQVFESIENSQALVDQSNRILSSAEKGNTG
(GenPept gbAAN52913.1).

-continued 2.2.5 PIV F
An exemplary PIV F precursor has the following amino acid sequence:

[SEQ ID NO: 75]
MPTSILLIITTMIMASFCQIDITKLQHVGVLVNSPKGMKISQNFETRY
LILSLIPKIEDSNSCGDQQIKQYKRLLDRLIIPLYDGLRLQKDVIVSN
QESNENTDPRTKRFFGGVIGTIALGVATSAQITAAVALVEAKQARSDI
EKLKEAIRDTNKAVQSVQSSIGNLIVAIKSVQDYVNKEIVPSIARLGC
EAAGLQLGIALTQHYSELTNIFGDNIGSLQEKGIKLQGIASLYRTNIT
EIFTTSTVDKYDIYDLLFTESIKVRVIDVDLNDYSITLQVRLPLLTRL
LNTQIYKVDSISYNIQNREWYIPLPSHIMTKGAFLGGADVKECIEAFS
SYICPSDPGFVLNHEMESCLSGNISQCPRTWTSDIVPRYAFVNGGVVA
NCITTTCTCNGIGNRINQPPDQGVKIITHKECNTIGINGMLFNTNKEG
TLAFYTPNDITLNNSVALDPIDISIELNKAKSDLEESKEWIRRSNQKL
DSIGNWHQSSTTIIIVLIMIIILFIINVTIIIIAVKYYRIQKRNRVDQ
NDKPYVLTNK
(GenPept gbAAB321447.1).

This sequence comprises the following domains/moieties:

SP=1-19
Ectodomain=1-493
Furin cleavage sites=109-110
FP=110-135
HRA region=136-168
HRB region=458-493
TM=494-516
C=517-536

Non-limiting examples of PIV F ectodomain polypeptides include:

Ectodomain 1-493:

[SEQ ID NO: 76]
MPTSILLIITTMIMASFCQIDITKLQHVGVLVNSPKGMKISQNFETRY
LILSLIPKIEDSNSCGDQQIKQYKRLLDRLIIPLYDGLRLQKDVIVSN
QESNENTDPRTKRFFGGVIGTIALGVATSAQITAAVALVEAKQARSDI
EKLKEAIRDTNKAVQSVQSSIGNLIVAIKSVQDYVNKEIVPSIARLGC
EAAGLQLGIALTQHYSELTNIFGDNIGSLQEKGIKLQGIASLYRTNIT
EIFTTSTVDKYDIYDLLFTESIKVRVIDVDLNDYSITLQVRLPLLTRL
LNTQIYKVDSISYNIQNREWYIPLPSHIMTKGAFLGGADVKECIEAFS
SYICPSDPGFVLNHEMESCLSGNISQCPRTVVTSDIVPRYAFVNGGVV
ANCITTTCTCNGIGNRINQPPDQGVKIITHKECNTIGINGMLFNTNKE
GTLAFYTPNDITLNNSVALDPIDISIELNKAKSDLEESKEWIRRSNQK
LDSIGNWHQSSTT
(GenPept gbAAB21447.1).

Ectodomain minus SP 20-493:

[SEQ ID NO: 77]
IDITKLQHVGVLVNSPKGMKISQNFETRYLILSLIPKIEDSNSCGDQQ
IKQYKRLLDRLIIPLYDGLRLQKDVIVSNQESNENTDPRTKRFFGGVI
GTIALGVATSAQITAAVALVEAKQARSDIEKLKEAIRDTNKAVQSVQS
SIGNLIVAIKSVQDYVNKEIVPSIARLGCEAAGLQLGIALTQHYSELT

-continued

NIFGDNIGSLQEKGIKLQGIASLYRTNITEIFTTSTVDKYDIYDLLFT
ESIKVRVIDVDLNDYSITLQVRLPLLTRLLNTQIYKVDSISYNIQNRE
WYIPLPSHIMTKGAFLGGADVKECIEAFSSYICPSDPGFVLNHEMESC
LSGNISQCPRTVVTSDIVPRYAFVNGGVVANCITTTCTCNGIGNRINQ
PPDQGVKIITHKECNTIGINGMLFNTNKEGTLAFYTPNDITLNNSVAL
DPIDISIELNKAKSDLEESKEWIRRSNQKLDSIGNWHQSSTT
(GenPept gbAAB21447.1).

Ectodomain minus SP plus altered furin cleavage sites 20-493:

[SEQ ID NO: 78]
IDITKLQHVGVLVNSPKGMKISQNFETRYLILSLIPKIEDSNSCGDQQ
IKQYKRLLDRLIIPLYDGLRLQKDVIVSNQESNENTDPNTKNFFGGVI
GTIALGVATSAQITAAVALVEAKQARSDIEKLKEAIRDTNKAVQSVQS
SIGNLIVAIKSVQDYVNKEIVPSIARLGCEAAGLQLGIALTQHYSELT
NIFGDNIGSLQEKGIKLQGIASLYRTNITEIFTTSTVDKYDIYDLLFT
ESIKVRVIDVDLNDYSITLQVRLPLLTRLLNTQIYKVDSISYNIQNRE
WYIPLPSHIMTKGAFLGGADVKECIEAFSSYICPSDPGFVLNHEMESC
LSGNISQCPRTVVTSDIVPRYAFVNGGVVANCITTTCTCNGIGNRINQ
PPDQGVKIITHKECNTIGINGMLFNTNKEGTLAFYTPNDITLNNSVAL
DPIDISIELNKAKSDLEESKEWIRRSNQKLDSIGNWHQSSTT
(GenPept gbAAB21447.1).

2.2.6 MeV F
A representative MeV F precursor has the following amino acid sequence:

[SEQ ID NO: 79]
MGLKVNVSAIFMAVLLTLQTPTGQIHWGNLSKIGVVGIGSASYKVMTR
SSHQSLVIKLMPNITLLNNCTRVEIAEYRRLLRTVLEPIRDALNAMTQ
NIRPVQSVASSRRHKRFAGVVLAGAALGVATAAQITAGIALHQSMLNS
QAIDNLRASLETTNQAIEAIRQAGQEMILAVQGVQDYINNELIPSMNQ
LSCDLIGQKLGLKLLRYYTEILSLFGPSLRDPISAEISIQALSYALGG
DINKVLEKLGYSGGDLLGILESRGIKARITHVDTESYLIVLSIAYPTL
SEIKGVIVHRLEGVSYNIGSQEWYTTVPKYVATQGYLISNFDESSCTF
MPEGTVCSQNALYPMSPLLQECLRGSTKSCARTLVSGSFGNRFILSQG
NLIANCASILCKCYTTGTIINQDPDKILTYIAADHCPVVEVNGVTIQV
GSRRYPDAVYLHRIDLGPPILLERLDVGTNLGNAIAKLEDAKELLESS
DQILRSMKGLSSTCIVYILIAVCLGGLIGIPALICCCRGRCNKKGEQV
GMSRPGLKPDLTGTSKSYVRSL
(GenPept dbjBAB60865.1).

This sequence comprises the following domains/moieties:

SP=1-24
Ectodomain=1-493
Furin cleavage sites=112-113
FP=113-137
HRA region=138-171
HRB region=454-493
TM=494-517
C=518-550

Non-limiting examples of MeV F ectodomain polypeptides include:

Ectodomain 1-493:
[SEQ ID NO: 80]
MGLKVNVSAIFMAVLLTLQTPTGQIHWGNLSKIGVVGIGSASYKVMTR

SSHQSLVIKLMPNITLLNNCTRVEIAEYRRLLRTVLEPIRDALNAMTQ

NIRPVQSVASSRRHKRFAGVVLAGAALGVATAAQITAGIALHQSMLNS

QAIDNLRASLETTNQAIEAIRQAGQEMILAVQGVQDYINNELIPSMNQ

LSCDLIGQKLGLKLLRYYTEILSLFGPSLRDPISAEISIQALSYALGG

DINKVLEKLGYSGGDLLGILESRGIKARITHVDTESYLIVLSIAYPTL

SEIKGVIVHRLEGVSYNIGSQEWYTTVPKYVATQGYLISNFDESSCTF

MPEGTVCSQNALYPMSPLLQECLRGSTKSCARTLVSGSFGNRFILSQG

NLIANCASTLCKCYTTGTIINQDPDKILTYIAADHCPVVEVNGVTIQV

GSRRYPDAVYLHRIDLGPPILLERLDVGTNLGNAIAKLEDAKELLESS

DQILRSMKGLSST
(GenPept dbjBAB60865.1).

Ectodomain minus SP 25-493:
[SEQ ID NO: 81]
IHWGNLSKIGVVGIGSASYKVMTRSSHQSLVIKLMPNITLLNNCTRVE

IAEYRRLLRTVLEPIRDALNAMTQNIRPVQSVASSRRHKRFAGVVLAG

AALGVATAAQITAGIALHQSMLNSQAIDNLRASLETTNQAIEAIRQAG

QEMILAVQGVQDYINNELIPSMNQLSCDLIGQKLGLKLLRYYTEILSL

FGPSLRDPISAEISIQALSYALGGDINKVLEKLGYSGGDLLGILESRG

IKARITHVDTESYLIVLSIAYPTLSEIKGVIVHRLEGVSYNIGSQEWY

TTVPKYVATQGYLISNFDESSCTFMPEGTVCSQNALYPMSPLLQECLR

GSTKSCARTLVSGSFGNRFILSQGNLIANCASILCKCYTTGTIINQDP

DKILTYIAADHCPVVEVNGVTIQVGSRRYPDAVYLHRIDLGPPILLER

LDVGTNLGNAIAKLEDAKELLESSDQILRSMKGLSST
(GenPept dbjBAB60865.1)

Ectodomain minus SP plus altered furin cleavage sites:
[SEQ ID NO: 82]
IHWGNLSKIGVVGIGSASYKVMTRSSHQSLVIKLMPNITLLNNCTRVE

IAEYRRLLRTVLEPIRDALNAMTQNIRPVQSVAS*SNN*HK*N*FAGVVLAG

AALGVATAAQITAGIALHQSMLNSQAIDNLRASLETTNQAIEAIRQAG

QEMILAVQGVQDYINNELIPSMNQLSCDLIGQKLGLKLLRYYTEILSL

FGPSLRDPISAEISIQALSYALGGDINKVLEKLGYSGGDLLGILESRG

IKARITHVDTESYLIVLSIAYPTLSEIKGVIVHRLEGVSYNIGSQEWY

TTVPKYVATQGYLISNFDESSCTFMPEGTVCSQNALYPMSPLLQECLR

GSTKSCARTLVSGSFGNRFILSQGNLIANCASILCKCYTTGTIINQDP

DKILTYIAADHCPVVEVNGVTIQVGSRRYPDAVYLHRIDLGPPILLER

LDVGTNLGNAIAKLEDAKELLESSDQILRSMKGLSST
(GenPept dbjBA860865.1).

2.2.7 HeV F
A non-limiting HeV F precursor has the following amino acid sequence:
[SEQ ID NO: 83]
MATQEVRLKCLLCGIIVLVLSLEGLGILHYEKLSKIGLVKGITRKYKI

KSNPLTKDIVIKMIPNVSNVSKCTGTVMENYKSRLTGILSPIKGAIEL

YNNNTHDLVGDVKLAGVVMAGIAIGIATAAQITAGVALYEAMKNADNI

NKLKSSIESTNEAVVKLQETAEKTVYVLTALQDYINTNLVPTIDQISC

KQTELALDLALSKYLSDLLFVFGPNLQDPVSNSMTIQAISQAFGGNYE

TLLRTLGYATEDFDDLLESDSIAGQIVYVDLSSYYIIVRVYFPILTEI

QQAYVQELLPVSFNNDNSEWISIVPNFVLIRNTLISNIEVKYCLITKK

SVICNQDYATPMTASVRECLTGSTDKCPRELVVSSHVPRFALSGGVLF

ANCISVTCQCQTTGRAISQSGEQTLLMIDNTTCTTVVLGNIIISLGKY

LGSINYNSESIAVGPPVYTDKVDISSQISSMNQSLQQSKDYIKEAQKI

LDTVNPSLISMLSMIILYVLSIAALCIGLITFISFVIVEKKRGNYSRL

DDRQVRPVSNGDLYYIGT
(GenPept NP_047111.2).

This sequence comprises the following domains/moieties:
SP=1-20
Ectodomain=1-487
Furin cleavage sites=109-110
FP=110-135
HRA region=136-169
HRB region=456-587
TM=488-518
C=519-546

Non-limiting examples of HeV F ectodomain polypeptides include:

Ectodomain 1-487:
[SEQ ID NO: 84]
MATQEVRLKCLLCGIIVLVLSLEGLGILHYEKLSKIGLVKGITRKYKI

KSNPLTKDIVIKMIPNVSNVSKCTGTVMENYKSRLTGILSPIKGAIEL

YNNNTHDLVGDVKLAGVVMAGIAIGIATAAQITAGVALYEAMKNADNI

NKLKSSIESTNEAVVKLQETAEKTVYVLTALQDYINTNLVPTIDQISC

KQTELALDLALSKYLSDLLFVFGPNLQDPVSNSMTIQAISQAFGGNYE

TLLRTLGYATEDFDDLLESDSIAGQIVYVDLSSYYIIVRVYFPILTEI

QQAYVQELLPVSFNNDNSEWISIVPNFVLIRNTLISNIEVKYCLITKK

SVICNQDYATPMTASVRECLTGSTDKCPRELVVSSHVPRFALSGGVLF

ANCISVTCQCQTTGRAISQSGEQTLLMIDNTTCTTVVLGNIIISLGKY

LGSINYNSESIAVGPPVYTDKVDISSQISSMNQSLQQSKDYIKEAQKI

LDTVNPS
(GenPept NP_047111.2).

Ectodomain minus SP 21-487:
[SEQ ID NO: 85]
SLEGLGILHYEKLSKIGLVKGITRKYKIKSNPLTKDIVIKMIPNVSNV

SKCTGTVMENYKSRLTGILSPIKGAIELYNNNTHDLVGDVKLAGVVMA

GIAIGIATAAQITAGVALYEAMKNADNINKLKSSIESTNEAVVKLQET

AEKTVYVLTALQDYINTNLVPTIDQISCKQTELALDLALSKYLSDLLF

-continued
```
VFGPNLQDPVSNSMTIQAISQAFGGNYETLLRTLGYATEDFDDLLESD

SIAGQIVYVDLSSYYIIVRVYFPILTEIQQAYVQELLPVSFNNDNSEW

ISIVPNFVLIRNTLISNIEVKYCLITKKSVICNQDYATPMTASVRECL

TGSTDKCPRELVVSSHVPRFALSGGVLFANCISVTCQCQTTGRAISQS

GEQTLLMIDNTTCTTVVLGNIIISLGKYLGSINYNSESIAVGPPVYTD

KVDISSQISSMNQSLQQSKDYIKEAQKILDTVNPS
(GenPept NP_047111.2).

Ectodomain minus SP plus altered furin cleavage
sites 21-487:
                                      [SEQ ID NO: 86]
SLEGLGILHYEKLSKIGLVKGITRKYKIKSNPLTKDIVIKMIPNVSNV

SKCTGTVMENYKSRLTGILSPIKGAIELYNNNTHDLVGDVALAGVVMA

GIAIGIATAAQITAGVALYEAMKNADNINKLKSSIESTNEAVVKLQET

AEKTVYVLTALQDYINTNLVPTIDQISCKQTELALDLALSKYLSDLLF

VFGPNLQDPVSNSMTIQAISQAFGGNYETLLRTLGYATEDFDDLLESD

SIAGQIVYVDLSSYYIIVRVYFPILTEIQQAYVQELLPVSFNNDNSEW

ISIVPNFVLIRNTLISNIEVKYCLITKKSVICNQDYATPMTASVRECL

TGSTDKCPRELVVSSHVPRFALSGGVLFANCISVTCQCQTTGRAISQS

GEQTLLMIDNTTCTTVVLGNIIISLGKYLGSINYNSESIAVGPPVYTD

KVDISSQISSMNQSLQQSKDYIKEAQKILDTVNPS
(GenPept NP_047111.2).

2.2.8 NiV F
A representative NiV F precursor has the
following amino acid sequence:
                                      [SEQ ID NO: 87]
MVVILDKRCYCNLLILILMISECSVGILHYEKLSKIGLVKGVTRKYKI

KSNPLTKDIVIKMIPNVSNMSQCTGSVMENYKTRLNGILTPIKGALEI

YKNNTHDLVGDVRLAGVIMAGVAIGIATAAQITAGVALYEAMKNADNI

NKLKSSIESTNEAVVKLQETAEKTVYVLTALQDYINTNLVPTIDKISC

KQTELSLDLALSKYLSDLLFVFGPNLQDPVSNSMTIQAISQAFGGNYE

TLLRTLGYATEDFDDLLESDSITGQIIYVDLSSYYIIVRVYFPILTEI

QQAYIQELLPVSFNNDNSEWISIVPNFILVRNTLISNIEIGFCLITKR

SVICNQDYATPMTNNMRECLTGSTEKCPRELVVSSHVPRFALSNGVLF

ANCISVTCQCQTTGRAISQSGEQTLLMIDNTTCPTAVLGNVIISLGKY

LGSVNYNSEGIAIGPPVFTDKVDISSQISSMNQSLQQSKDYIKEAQRL

LDTVNPSLISMLSMIILYVLSIASLCIGLITFISFIIVEKKRNTYSRL

EDRRVRPTSSGDLYYIGT
(GenPept NP 112026).
```

This sequence comprises the following domains/moieties:

SP=1-20

Ectodomain=1-487

Furin cleavage sites=109-110

FP=110-135

HRA region=136-169

HRB region=456-487

TM=488-518

C=519-546

Non-limiting examples of NiV F ectodomain polypeptides include:

```
Ectodomain 1-487:
                                      [SEQ ID NO: 88]
MVVILDKRCYCNLLILILMISECSVGILHYEKLSKIGLVKGVTRKYKI

KSNPLTKDIVIKMIPNVSNMSQCTGSVMENYKTRLNGILTPIKGALEI

YKNNTHDLVGDVRLAGVIMAGVAIGIATAAQITAGVALYEAMKNADNI

NKLKSSIESTNEAVVKLQETAEKTVYVLTALQDYINTNLVPTIDKISC

KQTELSLDLALSKYLSDLLFVFGPNLQDPVSNSMTIQAISQAFGGNYE

TLLRTLGYATEDFDDLLESDSITGQIIYVDLSSYYIIVRVYFPILTEI

QQAYIQELLPVSFNNDNSEWISIVPNFILVRNTLISNIEIGFCLITKR

SVICNQDYATPMTNNMRECLTGSTEKCPRELVVSSHVPRFALSNGVLF

ANCISVTCQCQTTGRAISQSGEQTLLMIDNTTCPTAVLGNVIISLGKY

LGSVNYNSEGIAIGPPVFTDKVDISSQISSMNQSLQQSKDYIKEAQRL

LDTVNPS
(GenPept NP 112026).

Ectodomain minus SP:
                                      [SEQ ID NO: 89]
SECSVGILHYEKLSKIGLVKGVTRKYKIKSNPLTKDIVIKMIPNVSNM

SQCTGSVMENYKTRLNGILTPIKGALEIYKNNTHDLVGDVRLAGVIMA

GVAIGIATAAQITAGVALYEAMKNADNINKLKSSIESTNEAVVKLQET

AEKTVYVLTALQDYINTNLVPTIDKISCKQTELSLDLALSKYLSDLLF

VFGPNLQDPVSNSMTIQAISQAFGGNYETLLRTLGYATEDFDDLLESD

SITGQIIYVDLSSYYIIVRVYFPILTEIQQAYIQELLPVSFNNDNSEW

ISIVPNFILVRNTLISNIEIGFCLITKRSVICNQDYATPMTNNMRECL

TGSTEKCPRELVVSSHVPRFALSNGVLFANCISVTCQCQTTGRAISQS

GEQTLLMIDNTTCPTAVLGNVIISLGKYLGSVNYNSEGIAIGPPVFTD

KVDISSQISSMNQSLQQSKDYIKEAQRLLDTVNPS
(GenPept NP 112026).

Ectodomain minus SP plus altered furin cleavage
sites:
                                      [SEQ ID NO: 90]
SECSVGILHYEKLSKIGLVKGVTRKYKIKSNPLTKDIVIKMIPNVSNM

SQCTGSVMENYKTRLNGILTPIKGALEIYKNNTHDLVGDVALAGVIMA

GVAIGIATAAQITAGVALYEAMKNADNINKLKSSIESTNEAVVKLQET

AEKTVYVLTALQDYINTNLVPTIDKISCKQTELSLDLALSKYLSDLLF

VFGPNLQDPVSNSMTIQAISQAFGGNYETLLRTLGYATEDFDDLLESD

SITGQIIYVDLSSYYIIVRVYFPILTEIQQAYIQELLPVSFNNDNSEW

ISIVPNFILVRNTLISNIEIGFCLITKRSVICNQDYATPMTNNMRECL

TGSTEKCPRELVVSSHVPRFALSNGVLFANCISVTCQCQTTGRAISQS

GEQTLLMIDNTTCPTAVLGNVIISLGKYLGSVNYNSEGIAIGPPVFTD

KVDISSQISSMNQSLQQSKDYIKEAQRLLDTVNPS
(GenPept NP 112026).
```

2.2.9 HIV GP160
An illustrative HIV GP160 precursor has the following amino acid sequence:
[SEQ ID NO: 91]
MRVKGTRKNYWWRWGTMLLGMLMICSAAEQLWVTVYYGVPVWKEATTT

LFCASDAKAVNTEVHNVWATHACVPTDPNPQEVVLENVTENFNMWKND

MVEQMQEDIISLWDQSLKPCVKLTPLCVTLNCTNWDGRNGTMNTTSTR

NTTTANISRWEMEGEIKNCSFNVTTSIRNKMHKEYALFYKLDVMPIDN

GSSYTLINCNTSVITQACPKVSFEPIPIHYCTPAGFALLKCNDKKFNG

TGPCKNVSTVQCTHGIRPVVSTQLLLNGSLAEEEIVIRSENLTDNAKT

IIVQLNETVVINCTRPGNNTRKSIHIGPGRAFYATGDIIGDIRQAHCN

LSEASWNKTLKQIATKLREQFVNKTIIFNQSSGGDPEIVMHSFNCGGE

FFYCDTTQLFNSAWFSNNTGLNYNNGSNTGGNITLPCRIKQIVNRWQE

VGKAMYAPPIRGNITCSSNITGLLLTRDGGNNVTNESEIFRPGGGNMK

DNWRSELYKYKVVKIEPLGVAPTRAKRRVVQREKRAVGTIGAMFLGFL

GAAGSTMGAASLTLTVQARQLLSGIVQQQNNLLRAIEAQQHLLQLTVW

GIKQLQARVLAVERYLKDQQLLGIWGCSGRLICTTAVPWNASWSNKSL

DDIWNNMTWMQWEKEIDNYTGLIYRLIEESQTQQEKNEQDLLQLDTWA

SLWNWFSISNWLWYIKIFIMIVAGLVGLRIFFAVLSIVNRVRQGYSPL

SFQTHLPAQRGPDRPGIEEEGGERDNGRSIRLVDGFLALIWDDLRSL

CLFSYHRLRDLLLLLVKRVVELLGHRGWEILKYWWNLLQYWSQELKNSA

VSLFNAIAIAVAEGTDRVIEGIQRIGRGFLHIPRRIRQGLERALL
(GenPept dbjBAF31430.1).

This sequence comprises the following domains/moieties:
SP=1-28
Ectodomain=1-688
Furin cleavage sites=508-509
FP=509-538
HRA region=539-587
HRB region=631-667
MPER=668-688
TM=689-711
C=712-861
GP41=509-861
GP120=1-508

Non-limiting examples of HIV GP160 ectodomain polypeptides include:

Ectodomain 1-688:
[SEQ ID NO: 92]
MRVKGTRKNYWWRWGTMLLGMLMICSAAEQLWVTVYYGVPVWKEATTT

LFCASDAKAVNTEVHNVWATHACVPTDPNPQEVVLENVTENFNMWKND

MVEQMQEDIISLWDQSLKPCVKLTPLCVTLNCTNWDGRNGTMNTTSTR

NTTTANISRWEMEGEIKNCSFNVTTSIRNKMHKEYALFYKLDVMPIDN

GSSYTLINCNTSVITQACPKVSFEPIPIHYCTPAGFALLKCNDKKFNG

TGPCKNVSTVQCTHGIRPVVSTQLLLNGSLAEEEIVIRSENLTDNAKT

IIVQLNETVVINCTRPGNNTRKSIHIGPGRAFYATGDIIGDIRQAHCN

LSEASWNKTLKQIATKLREQFVNKTIIFNQSSGGDPEIVMHSFNCGGE

FFYCDTTQLFNSAWFSNNTGLNYNNGSNTGGNITLPCRIKQIVNRWQE

VGKAMYAPPIRGNITCSSNITGLLLTRDGGNNVTNESEIFRPGGGNMK

DNWRSELYKYKVVKIEPLGVAPTRAKRRVVQREKRAVGTIGAMFLGFL

GAAGSTMGAASLTLTVQARQLLSGIVQQQNNLLRAIEAQQHLLQLTVW

GIKQLQARVLAVERYLKDQQLLGIWGCSGRLICTTAVPWNASWSNKSL

DDIWNNMTWMQWEKEIDNYTGLIYRLIEESQTQQEKNEQDLLQLDTWA

SLWNWFSISNWLWYIK
(GenPept dbjBAF31430.1).

Ectodomain minus SP:
[SEQ ID NO: 93]
EQLWVTVYYGVPVWKEATTTLFCASDAKAVNTEVHNVWATHACVPTDP

NPQEVVLENVTENFNMWKNDMVEQMQEDIISLWDQSLKPCVKLTPLCV

TLNCTNWDGRNGTMNTTSTRNTTTANISRWEMEGEIKNCSFNVTTSIR

NKMHKEYALFYKLDVMPIDNGSSYTLINCNTSVITQACPKVSFEPIPI

HYCTPAGFALLKCNDKKFNGTGPCKNVSTVQCTHGIRPVVSTQLLLNG

SLAEEEIVIRSENLTDNAKTIIVQLNETVVINCTRPGNNTRKSIHIGP

GRAFYATGDIIGDIRQAHCNLSEASWNKTLKQIATKLREQFVNKTIIF

NQSSGGDPEIVMHSFNCGGEFFYCDTTQLFNSAWFSNNTGLNYNNGSN

TGGNITLPCRIKQIVNRWQEVGKAMYAPPIRGNITCSSNITGLLLTRD

GGNNVTNESEIFRPGGGNMKDNWRSELYKYKVVKIEPLGVAPTRAKRR

VVQREKRAVGTIGAMFLGFLGAAGSTMGAASLTLTVQARQLLSGIVQQ

QNNLLRAIEAQQHLLQLTVWGIKQLQARVLAVERYLKDQQLLGIWGCS

GRLICTTAVPWNASWSNKSLDDIWNNMTWMQWEKEIDNYTGLIYRLIE

ESQTQQEKNEQDLLQLDTWASLWNWFSISNWLWYIK
(GenPept dbjBAF31430.1).

Ectodomain minus SP, minus MPER:
[SEQ ID NO: 94]
EQLWVTVYYGVPVWKEATTTLFCASDAKAVNTEVHNVWATHACVPTDP

NPQEVVLENVTENFNMWKNDMVEQMQEDIISLWDQSLKPCVKLTPLCV

TLNCTNWDGRNGTMNTTSTRNTTTANISRWEM+GEIKNCSFNVTTSIR

NKMHKEYALFYKLDVMPIDNGSSYTLINCNTSVITQACPKVSFEPIPI

HYCTPAGFALLKCNDKKFNGTGPCKNVSTVQCTHGIRPVVSTQLLLNG

SLAEEEIVIRSENLTDNAKTIIVQLNETVVINCTRPGNNTRKSIHIGP

GRAFYATGDIIGDIRQAHCNLSEASWNKTLKQIATKLREQFVNKTIIF

NQSSGGDPEIVMHSFNCGGEFFYCDTTQLFNSAWFSNNTGLNYNNGSN

TGGNITLPCRIKQIVNRWQEVGKAMYAPPIRGNITCSSNITGLLLTRD

GGNNVTNESEIFRPGGGNMKDNWRSELYKYKVVKIEPLGVAPTRAKRR

VVQREKRAVGTIGAMFLGFLGAAGSTMGAASLTLTVQARQLLSGIVQQ

QNNLLRAIEAQQHLLQLTVWGIKQLQARVLAVERYLKDQQLLGIWGCS

GRLICTTAVPWNASWSNKSLDDIWNNMTWMQWEKEIDNYTGLIYRLIE

ESQTQQEKNEQDLLQ
(GenPept dbjBAF31430.1).

-continued

Ectodomain minus SP plus altered furin cleavage sites:
[SEQ ID NO: 95]
EQLWVTVYYGVPVWKEATTTLFCASDAKAVNTEVHNVWATHACVPTDP

NPQEVVLENVTENFNMWKNDMVEQMQEDIISLWDQSLKPCVKLTPLCV

TLNCTNWDGRNGTMNTTSTRNTTTANISRWEMEGEIKNCSFNVTTSIR

NKMHKEYALFYKLDVMPIDNGSSYTLINCNTSVITQACPKVSFEPIPI

HYCTPAGFALLKCNDKKFNGTGPCKNVSTVQCTHGIRPVVSTQLLLNG

SLAEEEIVIRSENLTDNAKTIIVQLNETVVINCTRPGNNTRKSIHIGP

GRAFYATGDIIGDIRQAHCNLSEASWNKTLKQIATKLREQFVNKTIIF

NQSSGGDPEIVMHSFNCGGEFFYCDTTQLFNSAWFSNNTGLNYNNGSN

TGGNITLPCRIKQIVNRWQEVGKAMYAPPIRGNITCSSNITGLLLTRD

GGNNVTNESEIFRPGGGNMKDNWRSELYKYKVVKIEPLGVAPTNANNN

VVQREKRAVGTIGAMFLGFLGAAGSTMGAASLTLTVQARQLLSGIVQQ

QNNLLRAIEAQQHLLQLTVWGIKQLQARVLAVERYLKDQQLLGIWGCS

GRLICTTAVPWNASWSNKSLDDIWNNMTWMQWEKEIDNYTGLIYRLIE

ESQTQQEKNEQDLLQLDTWASLWNWFSISNWLWYIK
(GenPept dbjBAF31430.1).

GP41 ectodomain 509-688:
[SEQ ID NO: 96]
VVQREKRAVGTIGAMFLGFLGAAGSTMGAASLTLTVQARQLLSGIVQQ

QNNLLRAIEAQQHLLQLTVWGIKQLQARVLAVERYLKDQQLLGIWGCS

GRLICTTAVPWNASWSNKSLDDIWNNMTWMQWEKEIDNYTGLIYRLIE

ESQTQQEKNEQDLLQLDTWASLWNWFSISNWLWYIK
(GenPept dbjBAF31430.1).

2.2.10 EBOV GP
A representative EBOV GP precursor has the following amino acid sequence:
[SEQ ID NO: 97]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVSNGAKNISGQSPARTSSDPGTNTTT

EDHKIMASENSSAMVQVHSQGREAAVSHLTTLATISTSPQSLTTKPGP

DNSTHNTPVYKLDISEATQVEQHHRRTDNDSTASDTPSATTAAGPPKA

ENTNTSKSTDFLDPATTTSPQNHSETAGNNNTHHQDTGEESASSGKLG

LITNTIAGVAGLITGGRRTRREAIVNAQPKCNPNLHYWTTQDEGAAIG

LAWIPYFGPAAEGIYIEGLMHNQDGLICGLRQLANETTQALQLFLRAT

TELRTFSILNRKAIDFLLQRWGGTCHILGPDCCIEPHDWTKNITDKID

QIIHDFVDKTLPDQGDNDNWWTGWRQWIPAGIGVTGVIIAVIALFCIC

KFVF
(GenPept NP 066246.1).

This sequence comprises the following domains/moieties:
SP=1-27
Ectodomain=1-650

Furin cleavage sites=501-502
Cathepsin cleavage sites=191-192, 201-202
FP=511-556
HRA region=557-593
HRB region=600-635
MPER=636-650
TM=651-669
C=670-676
Mucin-like domain=312-461

Non-limiting examples of EBOV GP ectodomain polypeptides include:

Ectodomain 1-650:
[SEQ ID NO: 98]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVSNGAKNISGQSPARTSSDPGTNTTT

EDHKIMASENSSAMVQVHSQGREAAVSHLTTLATISTSPQSLTTKPGP

DNSTHNTPVYKLDISEATQVEQHHRRTDNDSTASDTPSATTAAGPPKA

ENTNTSKSTDFLDPATTTSPQNHSETAGNNNTHHQDTGEESASSGKLG

LITNTIAGVAGLITGGRRTRREAIVNAQPKCNPNLHYWTTQDEGAAIG

LAWIPYFGPAAEGIYIEGLMHNQDGLICGLRQLANETTQALQLFLRAT

TELRTFSILNRKAIDFLLQRWGGTCHILGPDCCIEPHDWTKNITDKID

QIIHDFVDKTLPDQGDNDNWWTGWRQ
(GenPept NP 066246.1)

Ectodomain minus SP:
[SEQ ID NO: 99]
QRTFSIPLGVIHNSTLQVSDVDKLVCRDKLSSTNQLRSVGLNLEGNGV

ATDVPSATKRWGFRSGVPPKVVNYEAGEWAENCYNLEIKKPDGSECLP

AAPDGIRGFPRCRYVHKVSGTGPCAGDFAFHKEGAFFLYDRLASTVIY

RGTTFAEGVVAFLILPQAKKDFFSSHPLREPVNATEDPSSGYYSTTIR

YQATGFGTNETEYLFEVDNLTYVQLESRFTPQFLLQLNETIYTSGKRS

NTTGKLIWKVNPEIDTTIGEWAFWETKKNLTRKIRSEELSFTVVSNGA

KNISGQSPARTSSDPGTNTTTEDHKIMASENSSAMVQVHSQGREAAVS

HLTTLATISTSPQSLTTKPGPDNSTHNTPVYKLDISEATQVEQHHRRT

DNDSTASDTPSATTAAGPPKAENTNTSKSTDFLDPATTTSPQNHSETA

GNNNTHHQDTGEESASSGKLGLITNTIAGVAGLITGGRRTRREAIVNA

QPKCNPNLHYWTTQDEGAAIGLAWIPYFGPAAEGIYIEGLMHNQDGLI

CGLRQLANETTQALQLFLRATTELRTFSILNRKAIDFLLQRWGGTCHI

LGPDCCIEPHDWTKNITDKIDQIIHDFVDKTLPDQGDNDNWWTGWRQ
(GenPept NP 066246.1).

Ectodomain minus SP, minus MPER:
[SEQ ID NO: 100]
QRTFSIPLGVIHNSTLQVSDVDKLVCRDKLSSTNQLRSVGLNLEGNGV

ATDVPSATKRWGFRSGVPPKVVNYEAGEWAENCYNLEIKKPDGSECLP

```
AAPDGIRGFPRCRYVHKVSGTGPCAGDFAFHKEGAFFLYDRLASTVIY

RGTTFAEGVVAFLILPQAKKDFFSSHPLREPVNATEDPSSGYYSTTIR

YQATGFGTNETEYLFEVDNLTYVQLESRFTPQFLLQLNETIYTSGKRS

NTTGKLIWKVNPEIDTTIGEWAFWETKKNLTRKIRSEELSFTVVSNGA

KNISGQSPARTSSDPGTNTTTEDHKIMASENSSAMVQVHSQGREAAVS

HLTTLATISTSPQSLTTKPGPDNSTHNTPVYKLDISEATQVEQHHRRT

DNDSTASDTPSATTAAGPPKAENTNTSKSTDFLDPATTTSPQNHSETA

GNNNTHHQDTGEESASSGKLGLITNTIAGVAGLITGGRRTRREAIVNA

QPKCNPNLHYWTTQDEGAAIGLAWIPYFGPAAEGIYIEGLMHNQDGLI

CGLRQLANETTQALQLFLRATTELRTFSILNRKAIDFLLQRWGGTCHI

LGPDCCIEPHDWTKNITDKIDQIIHDFVDKTL
(GenPept NP 066246.1).

Ectodomain minus SP plus altered furin cleavage
sites:
                                [SEQ ID NO: 101]
QRTFSIPLGVIHNSTLQVSDVDKLVCRDKLSSTNQLRSVGLNLEGNGV

ATDVPSATKRWGFRSGVPPKVVNYEAGEWAENCYNLEIKKPDGSECLP

AAPDGIRGFPRCRYVHKVSGTGPCAGDFAFHKEGAFFLYDRLASTVIY

RGTTFAEGVVAFLILPQAKKDFFSSHPLREPVNATEDPSSGYYSTTIR

YQATGFGTNETEYLFEVDNLTYVQLESRFTPQFLLQLNETIYTSGKRS

NTTGKLIWKVNPEIDTTIGEWAFWETKKNLTRKIRSEELSFTVVSNGA

KNISGQSPARTSSDPGTNTTTEDHKIMASENSSAMVQVHSQGREAAVS

HLTTLATISTSPQSLTTKPGPDNSTHNTPVYKLDISEATQVEQHHRRT

DNDSTASDTPSATTAAGPPKAENTNTSKSTDFLDPATTTSPQNHSETA

GNNNTHHQDTGEESASSGKLGLITNTIAGVAGLITGGNNTNNEAIVNA

QPKCNPNLHYWTTQDEGAAIGLAWIPYFGPAAEGIYIEGLMHNQDGLI

CGLRQLANETTQALQLFLRATTELRTFSILNRKAIDFLLQRWGGTCHI

LGPDCCIEPHDWTKNITDKIDQIIHDFVDKTL
(GenPept NP 066246.1).

Ectodomain minus SP, minus mucin-like domain:
                                [SEQ ID NO: 102]
QRTFSIPLGVIHNSTLQVSDVDKLVCRDKLSSTNQLRSVGLNLEGNGV

ATDVPSATKRWGFRSGVPPKVVNYEAGEWAENCYNLEIKKPDGSECLP

AAPDGIRGFPRCRYVHKVSGTGPCAGDFAFHKEGAFFLYDRLASTVIY

RGTTFAEGVVAFLILPQAKKDFFSSHPLREPVNATEDPSSGYYSTTIR

YQATGFGTNETEYLFEVDNLTYVQLESRFTPQFLLQLNETIYTSGKRS

NTTGKLIWKVNPEIDTTIGEWAFWETKKNLTRKIRSEELSFTVVGGNN

THHQDTGEESASSGKLGLITNTIAGVAGLITGGRRTRREAIVNAQPKC

NPNLHYWTTQDEGAAIGLAWIPYFGPAAEGIYIEGLMHNQDGLICGLR

QLANETTQALQLFLRATTELRTFSILNRKAIDFLLQRWGGTCHILGPD

CCIEPHDWTKNITDKIDQIIHDFVDKTLPDQGDNDNWWTGWRQ
(GenPept NP 066246.1).

Ectodomain minus mucin-like domain:
                                [SEQ ID NO: 154]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEESASSGKLGLITNTIAGVAGLITGGRRTRREA

IVNAQPKCNPNLHYWTTQDEGAAIGLAWIPYFGPAAEGIYIEGLMHNQ

DGLICGLRQLANETTQALQLFLRATTELRTFSILNRKAIDFLLQRWGG

TCHILGPDCCIEPHDWTKNITDKIDQIIHDFVDKTL 2.2.11 MARV GP
A non-limiting MARV GP precursor has the
following amino acid sequence:
                                [SEQ ID NO: 103]
MKTTCFLISLILIQGTKNLPILEIASNNQPQNVDSVCSGTLQKTEDVH

LMGFTLSGQKVADSPLEASKRWAFRTGVPPKNVEYTEGEEEAKTCYNIS

VTDPSGKSLLLDPPTNIRDYPKCKTIHHIQGQNPHAQGIALHLWGAFF

LYDRIASTTMYRGKVFTEGNIAAMIVNKTVHKMIFSRQGQGYRHMNLT

STNKYWTSSNGTQTNDTGCFGALQEYNSTKNQTCAPSKIPPPLPTARP

EIKLTSTPTDATKLNTTDPSSDDEDLATSGSGSGEREPHTTSDAVTKQ

GLSSTMPPTPSPQPSTPQQGGNNTNHSQDAVTELDKNNTTAQPSMPPH

NTTTISTNNTSKHNFSTLSAPLQNTTNDNTQSTITENEQTSAPSITTL

PPTGNPTTAKSTSSKKGPATTAPNTTNEHFTSPPPTPSSTAQHLVYFR

RKRSILWREGDMFPFLDGLINAPIDFDPVPNTKTIFDESSSSGASAEE

DQHASPNISLTLSYFPNINENTAYSGENENDCDAELRIWSVQEDDLAA

GLSWIPFFGPGIEGLYTAVLIKNQNNLVCRLRRLANQTAKSLELLLRV

TTEERTFSLINRHAIDFLLTRWGGTCKVLGPDCCIGIEDLSKNISEQI

DQIKKDEQKEGTGWGLGGKWWTSDWGVLTNLGILLLLSIAVLIALSCI

CRIFTKYIG
(GenPept YP_001531156.1).
```

This sequence comprises the following domains/moieties:
SP=1-19
Ectodomain=1-650
Furin cleavage sites=434-435
FP=526-549
HRA region=582-598
HRB region=611-627
MPER=628-650
TM=651-669
C=670-681
Mucin-like domain=244-425

Non-limiting examples of MARV GP ectodomain polypeptides include:

```
Ectodomain 1-650:
                                [SEQ ID NO: 104]
MKTTCFLISLILIQGTKNLPILEIASNNQPQNVDSVCSGTLQKTEDVH

LMGFTLSGQKVADSPLEASKRWAFRTGVPPKNVEYTEGEEEAKTCYNIS

VTDPSGKSLLLDPPTNIRDYPKCKTIHHIQGQNPHAQGIALHLWGAFF

LYDRIASTTMYRGKVFTEGNIAAMIVNKTVHKMIFSRQGQGYRHMNLT
```

-continued
STNKYWTSSNGTQTNDTGCFGALQEYNSTKNQTCAPSKIPPPLPTARP

EIKLTSTPTDATKLNTTDPSSDDEDLATSGSGSGEREPHTTSDAVTKQ

GLSSTMPPTPSPQPSTPQQGGNNTNHSQDAVTELDKNNTTAQPSMPPH

NTTTISTNNTSKHNFSTLSAPLQNTTNDNTQSTITENEQTSAPSITTL

PPTGNPTTAKSTSSKKGPATTAPNTTNEHFTSPPPTPSSTAQHLVYFR

RKRSILWREGDMFPFLDGLINAPIDFDPVPNTKTIFDESSSSGASAEE

DQHASPNISLTLSYFPNINENTAYSGENENDCDAELRIWSVQEDDLAA

GLSWIPFFGPGIEGLYTAVLIKNQNNLVCRLRRLANQTAKSLELLLRV

TTEERTFSLINRHAIDFLLTRWGGTCKVLGPDCCIGIEDLSKNISEQI

DQIKKDEQKEGTGWGLGGKWWTSDWG
(GenPept YP_001531156.1).

Ectodomain minus SP 20-650:
[SEQ ID NO: 105]
PILEIASNNQPQNVDSVCSGTLQKTEDVHLMGFTLSGQKVADSPLEAS

KRWAFRTGVPPKNVEYTEGEEAKTCYNISVTDPSGKSLLLDPPTNIRD

YPKCKTIHHIQGQNPHAQGIALHLWGAFFLYDRIASTTMYRGKVFTEG

NIAAMIVNKTVHKMIFSRQGQGYRHMNLTSTNKYWTSSNGTQTNDTGC

FGALQEYNSTKNQTCAPSKIPPPLPTARPEIKLTSTPTDATKLNTTDP

SSDDEDLATSGSGSGEREPHTTSDAVTKQGLSSTMPPTPSPQPSTPQQ

GGNNTNHSQDAVTELDKNNTTAQPSMPPHNTTTISTNNTSKHNFSTLS

APLQNTTNDNTQSTITENEQTSAPSITTLPPTGNPTTAKSTSSKKGPA

TTAPNTTNEHFTSPPPTPSSTAQHLVYFRRKRSILWREGDMFPFLDGL

INAPIDFDPVPNTKTIFDESSSSGASAEEDQHASPNISLTLSYFPNIN

ENTAYSGENENDCDAELRIWSVQEDDLAAGLSWIPFFGPGIEGLYTAV

LIKNQNNLVCRLRRLANQTAKSLELLLRVTTEERTFSLINRHAIDFLL

TRWGGTCKVLGPDCCIGIEDLSKNISEQIDQIKKDEQKEGTGWGLGGK

WWTSDWG
(GenPept YP_001531156.1).

Ectodomain minus SP, minus MPER 20-627:
[SEQ ID NO: 106]
PILEIASNNQPQNVDSVCSGTLQKTEDVHLMGFTLSGQKVADSPLEAS

KRWAFRTGVPPKNVEYTEGEEAKTCYNISVTDPSGKSLLLDPPTNIRD

YPKCKTIHHIQGQNPHAQGIALHLWGAFFLYDRIASTTMYRGKVFTEG

NIAAMIVNKTVHKMIFSRQGQGYRHMNLTSTNKYWTSSNGTQTNDTGC

FGALQEYNSTKNQTCAPSKIPPPLPTARPEIKLTSTPTDATKLNTTDP

SSDDEDLATSGSGSGEREPHTTSDAVTKQGLSSTMPPTPSPQPSTPQQ

GGNNTNHSQDAVTELDKNNTTAQPSMPPHNTTTISTNNTSKHNFSTLS

APLQNTTNDNTQSTITENEQTSAPSITTLPPTGNPTTAKSTSSKKGPA

TTAPNTTNEHFTSPPPTPSSTAQHLVYFRRKRSILWREGDMFPFLDGL

INAPIDFDPVPNTKTIFDESSSSGASAEEDQHASPNISLTLSYFPNIN

ENTAYSGENENDCDAELRIWSVQEDDLAAGLSWIPFFGPGIEGLYTAV

LIKNQNNLVCRLRRLANQTAKSLELLLRVTTEERTFSLINRHAIDFLL

TRWGGTCKVLGPDCCIGIEDLSKNISEQIDQI
(GenPept YP_001531156.1).

Ectodomain minus SP plus altered furin cleavage sites:
[SEQ ID NO: 107]
PILEIASNNQPQNVDSVCSGTLQKTEDVHLMGFTLSGQKVADSPLEAS

KRWAFRTGVPPKNVEYTEGEEAKTCYNISVTDPSGKSLLLDPPTNIRD

YPKCKTIHHIQGQNPHAQGIALHLWGAFFLYDRIASTTMYRGKVFTEG

NIAAMIVNKTVHKMIFSRQGQGYRHMNLTSTNKYWTSSNGTQTNDTGC

FGALQEYNSTKNQTCAPSKIPPPLPTARPEIKLTSTPTDATKLNTTDP

SSDDEDLATSGSGSGEREPHTTSDAVTKQGLSSTMPPTPSPQPSTPQQ

GGNNTNHSQDAVTELDKNNTTAQPSMPPHNTTTISTNNTSKHNFSTLS

APLQNTTNDNTQSTITENEQTSAPSITTLPPTGNPTTAKSTSSKKGPA

TTAPNTTNEHFTSPPPTPSSTAQHLVYF*NNNN*SILWREGDMFPFLDGL

INAPIDFDPVPNTKTIFDESSSSGASAEEDQHASPNISLTLSYFPNIN

ENTAYSGENENDCDAELRIWSVQEDDLAAGLSWIPFFGPGIEGLYTAV

LIKNQNNLVCRLRRLANQTAKSLELLLRVTTEERTFSLINRHAIDFLL

TRWGGTCKVLGPDCCIGIEDLSKNISEQIDQIKKDEQKEGTGWGLGGK

WWTSDWG
(GenPept YP_001531156.1).

Ectodomain minus SP, minus mucin-like domain:
[SEQ ID NO: 108]
PILEIASNNQPQNVDSVCSGTLQKTEDVHLMGFTLSGQKVADSPLEAS

KRWAFRTGVPPKNVEYTEGEEAKTCYNISVTDPSGKSLLLDPPTNIRD

YPKCKTIHHIQGQNPHAQGIALHLWGAFFLYDRIASTTMYRGKVFTEG

NIAAMIVNKTVHKMIFSRQGQGYRHMNLTSTNKYWTSSNGTQTNDTGC

FGALQEYNSTKNQTCAPSKIPPPLPTARPEIKLGGAQHLVYFRRKRSI

LWREGDMFPFLDGLINAPIDFDPVPNTKTIFDESSSSGASAEEDQHAS

PNISLTLSYFPNINENTAYSGENENDCDAELRIWSVQEDDLAAGLSWI

PFFGPGIEGLYTAVLIKNQNNLVCRLRRLANQTAKSLELLLRVTTEER

TFSLINRHAIDFLLTRWGGTCKVLGPDCCIGIEDLSKNISEQIDQIKK

DEQKEGTGWGLGGKWWTSDWG
(GenPept YP_001531156.1).

2.2.12 SARS-CoV S
An illustrative SARS-CoV S precursor has the following amino acid sequence:
[SEQ ID NO: 109]
MFIFLLFLTLTSGSDLDRCTTFDDVQAPNYTQHTSSMRGVYYPDEIFR

SDTLYLTQDLFLPFYSNVTGFHTINHTFGNPVIPFKDGIYFAATEKSN

VVRGWVFGSTMNNKSQSVIIINNSTNVVIRACNFELCDNPFFAVSKPM

GTQTHTMIFDNAFNCTFEYISDAFSLDVSEKSGNFKHLREFVFKNKDG

FLYVYKGYQPIDVVRDLPSGFNTLKPIFKLPLGINITNFRAILTAFSP

AQDIWGTSAAAYFVGYLKPTTFMLKYDENGTITDAVDCSQNPLAELKC

SVKSFEIDKGIYQTSNFRVVPSGDVVRFPNITNLCPFGEVFNATKFPS

VYAWERKKISNCVADYSVLYNSTFFSTFKCYGVSATKLNDLCFSNVYA

DSFVVKGDDVRQIAPGQTGVIADYNYKLPDDFMGCVLAWNTRNIDATS

TGNYNYKYRYLRHGKLRPFERDISNVPFSPDGKPCTPPALNCYWPLND

YGFYTTTGIGYQPYRVVVLSFELLNAPATVCGPKLSTDLIKNQCVNFN

-continued
```
FNGLTGTGVLTPSSKRFQPFQQFGRDVSDFTDSVRDPKTSEILDISPC

AFGGVSITPGTNASSEVAVLYQDVNCTNVSAAIHADQLTPAWRIYST

GNNVFQTQAGCLIGAEHVDTSYECDIPIGAGICASYHTVSLLRSTSQK

SIVAYTMSLGADSSIAYSNNTIAIPTNFSISITTEVMPVSMAKTSVDC

NMYICGDSTECANLLLQYGSFCTQLNRALSGIAAEQDRNTREVFAQVK

QMYKTPTLKYFGGFNFSQILPDPLKPTKRSFIEDLLFNKVTLADAGFM

KQYGECLGDINARDLICAQKFNGLTVLPPLLTDDMIAAYTAALVSGTA

TAGWTFGAGAALQIPFAMQMAYRFNGIGVTQNVLYENQKQIANQFNKA

ISQIQESLTTTSTALGKLQDVVNQNAQALNTLVKQLSSNFGAISSVLN

DILSRLDKVEAEVQIDRLITGRLQSLQTYVTQQLIRAAEIRASANLAA

TKMSECVLGQSKRVDFCGKGYHLMSFPQAAPHGVVFLHVTYVPSQERN

FTTAPAICHEGKAYFPREGVFVFNGTSWFITQRNFFSPQIITTDNTFV

SGNCDVVIGIINNTVYDPLQPELDSFKGELDKYFKNHTSPDVDLGDIS

GINASVVNIQKEIDRLNEVAKNLNESLIDLQELGKYEQYIKWPWYVWL

GFIAGLIAIVMVTILLCCMTSCCSCLKGACSCGSCCKFDEDDSEPVLK

GVKLHYT
(GenPept gbAAR86788.1).
```

This sequence comprises the following domains/moieties:
SP=1-13
Ectodomain=1-1199?
human airway trypsin-like protease cleavage sites=667-668
FP=770-788
HRA region=892-1013
HRB region=1145-1187
MPER=1188-1199
TM=1200-1216
C=1217-1255

Non-limiting examples of SARS-CoV S ectodomain polypeptides include:

Ectodomain 1-1199:
[SEQ ID NO: 110]
```
MFIFLLFLTLTSGSDLDRCTTFDDVQAPNYTQHTSSMRGVYYPDEIFR

SDTLYLTQDLFLPFYSNVTGFHTINHTFGNPVIPFKDGIYFAATEKSN

VVRGWVFGSTMNNKSQSVIIINNSTNVVIRACNFELCDNPFFAVSKPM

GTQTHTMIFDNAFNCTFEYISDAFSLDVSEKSGNFKHLREFVFKNKDG

FLYVYKGYQPIDVVRDLPSGFNTLKPIFKLPLGINITNFRAILTAFSP

AQDIWGTSAAAYFVGYLKPTTFMLKYDENGTITDAVDCSQNPLAELKC

SVKSFEIDKGIYQTSNFRVVPSGDVVRFPNITNLCPFGEVFNATKFPS

VYAWERKKISNCVADYSVLYNSTFFSTFKCYGVSATKLNDLCFSNVYA

DSFVVKGDDVRQIAPGQTGVIADYNYKLPDDFMGCVLAWNTRNIDATS

TGNYNYKYRYLRHGKLRPFERDISNVPFSPDGKPCTPPALNCYWPLND

YGFYTTTGIGYQPYRVVVLSFELLNAPATVCGPKLSTDLIKNQCVNFN

FNGLTGTGVLTPSSKRFQPFQQFGRDVSDFTDSVRDPKTSEILDISPC

AFGGVSITPGTNASSEVAVLYQDVNCTNVSAAIHADQLTPAWRIYST

GNNVFQTQAGCLIGAEHVDTSYECDIPIGAGICASYHTVSLLRSTSQK

SIVAYTMSLGADSSIAYSNNTIAIPTNFSISITTEVMPVSMAKTSVDC

NMYICGDSTECANLLLQYGSFCTQLNRALSGIAAEQDRNTREVFAQVK

QMYKTPTLKYFGGFNFSQILPDPLKPTKRSFIEDLLFNKVTLADAGFM

KQYGECLGDINARDLICAQKFNGLTVLPPLLTDDMIAAYTAALVSGTA

TAGWTFGAGAALQIPFAMQMAYRFNGIGVTQNVLYENQKQIANQFNKA

ISQIQESLTTTSTALGKLQDVVNQNAQALNTLVKQLSSNFGAISSVLN

DILSRLDKVEAEVQIDRLITGRLQSLQTYVTQQLIRAAEIRASANLAA

TKMSECVLGQSKRVDFCGKGYHLMSFPQAAPHGVVFLHVTYVPSQERN

FTTAPAICHEGKAYFPREGVFVFNGTSWFITQRNFFSPQIITTDNTFV

SGNCDVVIGIINNWYDPLQPELDSFKGELDKYFKNHTSPDVDLGDISG

INASVVNIQKEIDRLNEVAKNLNESLIDLQELGKYEQYIKWPWYVW
(GenPept gbAAR86788.1).
```

Ectodomain minus SP:
[SEQ ID NO: 111]
```
SDLDRCTTFDDVQAPNYTQHTSSMRGVYYPDEIFRSDTLYLTQDLFLP

FYSNVTGFHTINHTFGNPVIPFKDGIYFAATEKSNVVRGWVFGSTMNN

KSQSVIIINNSTNVVIRACNFELCDNPFFAVSKPMGTQTHTMIFDNAF

NCTFEYISDAFSLDVSEKSGNFKHLREFVFKNKDGFLYVYKGYQPIDV

VRDLPSGFNTLKPIFKLPLGINITNFRAILTAFSPAQDIWGTSAAAYF

VGYLKPTTFMLKYDENGTITDAVDCSQNPLAELKCSVKSFETDKGIYQ

TSNFRVVPSGDVVRFPNITNLCPFGEVFNATKFPSVYAWERKKISNCV

ADYSVLYNSTFFSTFKCYGVSATKLNDLCFSNVYADSFVVKGDDVRQI

APGQTGVIADYNYKLPDDFMGCVLAWNTRNIDATSTGNYNYKYRYLRH

GKLRPFERDISNVPFSPDGKPCTPPALNCYWPLNDYGFYTTTGIGYQP

YRVVVLSFELLNAPATVCGPKLSTDLIKNQCVNFNFNGLTGTGVLTPS

SKRFQPFQQFGRDVSDFTDSVRDPKTSETLDISPCAFGGVSITPGTN

ASSEVAVLYQDVNCTNVSAAIHADQLTPAWRIYSTGNNVFQTQAGCLI

GAEHVDTSYECDIPIGAGICASYHTVSLLRSTSQKSIVAYTMSLGADS

SIAYSNNTIAIPTNFSISITTEVMPVSMAKTSVDCNMYICGDSTECAN

LLLQYGSFCTQLNRALSGIAAEQDRNTREVFAQVKQMYKTPTLKYFGG

FNFSQILPDPLKPTKRSFIEDLLFNKVTLADAGFMKQYGECLGDINAR

DLICAQKFNGLTVLPPLLTDDMIAAYTAALVSGTATAGWTFGAGAALQ

IPFAMQMAYRFNGIGVTQNVLYENQKQIANQFNKAISQIQESLTTTST

ALGKLQDVVNQNAQALNTLVKQLSSNFGAISSVLNDILSRLDKVEAEV

QIDRLITGRLQSLQTYVTQQLIRAAEIRASANLAATKMSECVLGQSKR

VDFCGKGYHLMSFPQAAPHGVVFLHVTYVPSQERNFTTAPAICHEGKA

YFPREGVFVFNGTSWFITQRNFFSPQIITTDNTFVSGNCDVVIGIINN

TVYDPLQPELDSFKGELDKYFKNHTSPDVDLGDISGINASVVNIQKEI

DRLNEVAKNLNESLIDLQELGKYEQYIKWPWYVW
(GenPept gbAAR86788.1).
```

Ectodomain minus SP, minus MPER:
[SEQ ID NO: 112]
SDLDRCTTFDDVQAPNYTQHTSSMRGVYYPDEIFRSDTLYLTQDLFLP
FYSNVTGFHTINHTFGNPVIPFKDGIYFAATEKSNVVRGWVFGSTMNN
KSQSVIIINNSTNVVIRACNFELCDNPFFAVSKPMGTQTHTMIFDNAF
NCTFEYISDAFSLDVSEKSGNFKHLREFVFKNKDGFLYVYKGYQPIDV
VRDLPSGFNTLKPIFKLPLGINITNFRAILTAFSPAQDIWGTSAAAYF
VGYLKPTTFMLKYDENGTITDAVDCSQNPLAELKCSVKSFEIDKGIYQ
TSNFRVVPSGDVVRFPNITNLCPFGEVFNATKFPSVYAWERKKISNCV
ADYSVLYNSTFFSTFKCYGVSATKLNDLCFSNVYADSFVVKGDDVRQI
APGQTGVIADYNYKLPDDFMGCVLAWNTRNIDATSTGNYNYKYRYLRH
GKLRPFERDISNVPFSPDGKPCTPPALNCYWPLNDYGFYTTTGIGYQP
YRVVVLSFELLNAPATVCGPKLSTDLIKNQCVNFNFNGLTGTGVLTPS
SKRFQPFQQFGRDVSDFTDSVRDPKTSEILDISPCAFGGVSVITPGTN
ASSEVAVLYQDVNCTNVSAAIHADQLTPAWRIYSTGNNVFQTQAGCLI
GAEHVDTSYECDIPIGAGICASYHTVSLLRSTSQKSIVAYTMSLGADS
SIAYSNNTIAIPTNFSISITTEVMPVSMAKTSVDCNMYICGDSTECAN
LLLQYGSFCTQLNRALSGIAAEQDRNTREVFAQVKQMYKTPTLKYFGG
FNFSQILPDPLKPTKRSFIEDLLFNKVTLADAGFMKQYGECLGDINAR
DLICAQKFNGLTVLPPLLTDDMIAAYTAALVSGTATAGWTFGAGAALQ
IPFAMQMAYRFNGIGVTQNVLYENQKQIANQFNKAISQIQESLTTTST
ALGKLQDVVNQNAQALNTLVKQLSSNFGAISSVLNDILSRLDKVEAEV
QIDRLITGRLQSLQTYVTQQLIRAAEIRASANLAATKMSECVLGQSKR
VDFCGKGYHLMSFPQAAPHGVVFLHVTYVPSQERNFTTAPAICHEGKA
YFPREGVFVFNGTSWFITQRNFFSPQIITTDNTFVSGNCDVVIGIINN
TVYDPLQPELDSFKGELDKYFKNHTSPDVDLGDISGINASVVNIQKEI
DRLNEVAKNLNESLIDLQELGK
(GenPept gbAAR86788.1).

2.2.13 MERS-CoV S
An exemplary MERS-CoV S precursor has the following amino acid sequence:
[SEQ ID NO: 113]
MIHSVFLLMFLLTPTESYVDVGPDSVKSACIEVDIQQTFFDKTWPRPI
DVSKADGIIYPQGRTYSNITITYQGLFPYQGDHGDMYVYSAGHATGTT
PQKLFVANYSQDVKQFANGFVVRIGAAANSTGTVIISPSTSATIRKIY
PAFMLGSSVGNFSDGKMGRFFNHTLVLLPDGCGTLLRAFYCILEPRSG
NHCPAGNSYTSFATYHTPATDCSDGNYNRNASLNSFKEYFNLRNCTFM
YTYNITEDEILEWFGITQTAQGVHLFSSRYVDLYGGNMFQFATLPVYD
TIKYYSIIPHSIRSIQSDRKAWAAFYVYKLQPLTFLLDFSVDGYIRRA
IDCGFNDLSQLHCSYESFDVESGVYSVSSFEAKPSGSVVEQAEGVECD
FSPLLSGTPPQVYNFKRLVFTNCNYNLTKLLSLFSVNDFTCSQISPAA
IASNCYSSLILDYFSYPLSMKSDLGVSSAGPISQFNYKQSFSNPTCLI
LATVPHNLTTITKPLKYSYINKCSRLLSDDRTEVPQLVNANQYSPCVS
IVPSTVWEDGDYYRKQLSPLEGGGWLVASGSTVAMTEQLQMGFGITVQ
YGTDTNSVCPKLEFANDTKIASQLGNCVEYSLYGVSGRGVFQNCTAVG
VRQQRFVYDAYQNLVGYYSDDGNYYCLRACVSVPVSVIYDKETKTHAT
LFGSVACEHISSTMSQYSRSTRSMLKRRDSTYGPLQTPVGCVLGLVNS
SLFVEDCKLPLGQSLCALPDTPSTLTPRSVRSVPGEMRLASIAFNHPI
QVDQFNSSYFKLSIPTNFSFGVTQEYIQTTIQKVTVDCKQYICNGFQK
CEQLLREYGQFCSKINQALHGANLRQDDSVRNLFASVKSSQSSPIIPG
FGGDFNLTLLEPVSISTGSRSARSAIEDLLFDKVTIADPGYMQGYDDC
MQQGPASARDLICAQYVAGYKVLPPLMDVNMEAAYTSSLLGSIAGVGW
TAGLSSFAAIPFAQSIFYRLNGVGITQQVLSENQKLIANKFNQALGAM
QTGFTTTNEAFRKVQDAVNNNAQALSKLASELSNTFGAISASIGDIIQ
RLDVLEQDAQIDRLINGRLTTLNAFVAQQLVRSESAALSAQLAKDKVN
ECVKAQSKRSGFCGQGTHIVSFVVNAPNGLYFMHVGYYPSNHIEVVSA
YGLCDAANPTNCIAPVNGYFIKTNNTRIVDEWSYTGSSFYSPEPITSL
NTKYVAPQVTYQNISTNLPPPLLGNSTGIDFQDELDEFFKNVSTSIPN
FGSLTQINTTLLDLTYEMLSLQQVVKALNESYIDLKELGNYTYYNKWP
WYIWLGFIAGLVALALCVFFILCCTGCGTNCMGKLKCNRCCDRYEEYD
LEPHKVHVH
(GenPept gbAHX00711.1).

This sequence comprises the following domains/moieties:
SP=1-21
Ectodomain=1-1301
Furin cleavage sites=751-752, 887-888
FP=888-891, 951-980
HRA region=984-1105
HRB region=1248-1291
MPER=1292-1301
TM=1302-1318
C=1319-1353
Non-limiting examples of MERS-CoV S ectodomain polypeptides include:

Ectodomain 1-1301:
[SEQ ID NO: 114]
MIHSVFLLMFLLTPTESYVDVGPDSVKSACIEVDIQQTFFDKTWPRPI
DVSKADGIIYPQGRTYSNITITYQGLFPYQGDHGDMYVYSAGHATGTT
PQKLFVANYSQDVKQFANGFVVRIGAAANSTGTVIISPSTSATIRKIY
PAFMLGSSVGNFSDGKMGRFFNHTLVLLPDGCGTLLRAFYCILEPRSG
NHCPAGNSYTSFATYHTPATDCSDGNYNRNASLNSFKEYFNLRNCTFM
YTYNITEDEILEWFGITQTAQGVHLFSSRYVDLYGGNMFQFATLPVYD
TIKYYSIIPHSIRSIQSDRKAWAAFYVYKLQPLTFLLDFSVDGYIRRA
IDCGFNDLSQLHCSYESFDVESGVYSVSSFEAKPSGSVVEQAEGVECD
FSPLLSGTPPQVYNFKRLVFTNCNYNLTKLLSLFSVNDFTCSQISPAA
IASNCYSSLILDYFSYPLSMKSDLGVSSAGPISQFNYKQSFSNPTCLI
LATVPHNLTTITKPLKYSYINKCSRLLSDDRTEVPQLVNANQYSPCVS
IVPSTVWEDGDYYRKQLSPLEGGGWLVASGSTVAMTEQLQMGFGITVQ
YGTDTNSVCPKLEFANDTKIASQLGNCVEYSLYGVSGRGVFQNCTAVG

VRQQRFVYDAYQNLVGYYSDDGNYYCLRACVSVPVSVIYDKETKTHAT

LFGSVACEHISSTMSQYSRSTRSMLKRRDSTYGPLQTPVGCVLGLVNS

SLFVEDCKLPLGQSLCALPDTPSTLTPRSVRSVPGEMRLASIAFNHPI

QVDQFNSSYFKLSIPTNFSFGVTQEYIQTTIQKVTVDCKQYICNGFQK

CEQLLREYGQFCSKINQALHGANLRQDDSVRNLFASVKSSQSSPIIPG

FGGDFNLTLLEPVSISTGSRSARSAIEDLLFDKVTIADPGYMQGYDDC

MQQGPASARDLICAQYVAGYKVLPPLMDVNMEAAYTSSLLGSIAGVGW

TAGLSSFAAIPFAQSIFYRLNGVGITQQVLSENQKLIANKFNQALGAM

QTGFTTTNEAFRKVQDAVNNNAQALSKLASELSNTFGAISASIGDIIQ

RLDVLEQDAQIDRLINGRLTTLNAFVAQQLVRSESAALSAQLAKDKVN

ECVKAQSKRSGFCGQGTHIVSFVVNAPNGLYFMHVGYYPSNHIEVVSA

YGLCDAANPTNCIAPVNGYFIKTNNTRIVDEWSYTGSSFYSPEPITSL

NTKYVAPQVTYQNISTNLPPPLLGNSTGIDFQDELDEFFKNVSTSIPN

FGSLTQINTTLLDLTYEMLSLQQVVKALNESYIDLKELGNYTYYNKWP

WYIWL.
(GenPept gbAHX00711.1)

Ectodomain minus SP 22-1301:
[SEQ ID NO: 115]
GPDSVKSACIEVDIQQTFFDKTWPRPIDVSKADGITYPQGRTYSNITI

TYQGLFPYQGDHGDMYVYSAGHATGTTPQKLFVANYSQDVKQFANGFV

VRIGAAANSTGTVIISPSTSATIRKIYPAFMLGSSVGNFSDGKMGRFF

NHTLVLLPDGCGTLLRAFYCILEPRSGNHCPAGNSYTSFATYHTPATD

CSDGNYNRNASLNSFKEYFNLRNCTFMYTYNITEDEILEWFGITQTAQ

GVHLFSSRYVDLYGGNMFQFATLPVYDTIKYYSIIPHSIRSIQSDRKA

WAAFYVYKLQPLTFLLDFSVDGYIRRAIDCGFNDLSQLHCSYESFDVE

SGVYSVSSFEAKPSGSVVEQAEGVECDFSPLLSGTPPQVYNFKRLVFT

NCNYNLTKLLSLFSVNDFTCSQISPAAIASNCYSSLILDYFSYPLSMK

SDLGVSSAGPISQFNYKQSFSNPTCLILATVPHNLTTITKPLKYSYIN

KCSRLLSDDRTEVPQLVNANQYSPCVSIVPSTVWEDGDYYRKQLSPLE

GGGWLVASGSTVAMTEQLQMGFGITVQYGTDTNSVCPKLEFANDTKIA

SQLGNCVEYSLYGVSGRGVFQNCTAVGVRQQRFVYDAYQNLVGYYSDD

GNYYCLRACVSVPVSVIYDKETKTHATLFGSVACEHISSTMSQYSRST

RSMLKRRDSTYGPLQTPVGCVLGLVNSSLFVEDCKLPLGQSLCALPDT

PSTLTPRSVRSVPGEMRLASIAFNHPIQVDQFNSSYFKLSIPTNFSFG

VTQEYIQTTIQKVTVDCKQYICNGFQKCEQLLREYGQFCSKINQALHG

ANLRQDDSVRNLFASVKSSQSSPIIPGFGGDFNLTLLEPVSISTGSRS

ARSAIEDLLFDKVTIADPGYMQGYDDCMQQGPASARDLICAQYVAGYK

VLPPLMDVNMEAAYTSSLLGSIAGVGWTAGLSSFAAIPFAQSIFYRLN

GVGITQQVLSENQKLIANKFNQALGAMQTGFTTTNEAFRKVQDAVNNN

AQALSKLASELSNTFGAISASIGDIIQRLDVLEQDAQIDRLINGRLTT

LNAFVAQQLVRSESAALSAQLAKDKVNECVKAQSKRSGFCGQGTHIVS

FVVNAPNGLYFMHVGYYPSNHIEVVSAYGLCDAANPTNCIAPVNGYFI

KTNNTRIVDEWSYTGSSFYSPEPITSLNTKYVAPQVTYQNISTNLPPP

LLGNSTGIDFQDELDEFFKNVSTSIPNFGSLTQINTTLLDLTYEMLSL

QQVVKALNESYIDLKELGNYTYYNKWPWYIWL.
(GenPept gbAHX00711.1)

Ectodomain minus SP, minus MPER 22-1291:
[SEQ ID NO: 116]
GPDSVKSACIEVDIQQTFFDKTWPRPIDVSKADGITYPQGRTYSNITI

TYQGLFPYQGDHGDMYVYSAGHATGTTPQKLFVANYSQDVKQFANGFV

VRIGAAANSTGTVIISPSTSATIRKIYPAFMLGSSVGNFSDGKMGRFF

NHTLVLLPDGCGTLLRAFYCILEPRSGNHCPAGNSYTSFATYHTPATD

CSDGNYNRNASLNSFKEYFNLRNCTFMYTYNITEDEILEWFGITQTAQ

GVHLFSSRYVDLYGGNMFQFATLPVYDTIKYYSIIPHSIRSIQSDRKA

WAAFYVYKLQPLTFLLDFSVDGYIRRAIDCGFNDLSQLHCSYESFDVE

SGVYSVSSFEAKPSGSVVEQAEGVECDFSPLLSGTPPQVYNFKRLVFT

NCNYNLTKLLSLFSVNDFTCSQISPAAIASNCYSSLILDYFSYPLSMK

SDLGVSSAGPISQFNYKQSFSNPTCLILATVPHNLTTITKPLKYSYIN

KCSRLLSDDRTEVPQLVNANQYSPCVSIVPSTVWEDGDYYRKQLSPLE

GGGWLVASGSTVAMTEQLQMGFGITVQYGTDTNSVCPKLEFANDTKIA

SQLGNCVEYSLYGVSGRGVFQNCTAVGVRQQRFVYDAYQNLVGYYSDD

GNYYCLRACVSVPVSVIYDKETKTHATLFGSVACEHISSTMSQYSRST

RSMLKRRDSTYGPLQTPVGCVLGLVNSSLFVEDCKLPLGQSLCALPDT

PSTLTPRSVRSVPGEMRLASIAFNHPIQVDQFNSSYFKLSIPTNFSFG

VTQEYIQTTIQKVTVDCKQYICNGFQKCEQLLREYGQFCSKINQALHG

ANLRQDDSVRNLFASVKSSQSSPIIPGFGGDFNLTLLEPVSISTGSRS

ARSAIEDLLFDKVTIADPGYMQGYDDCMQQGPASARDLICAQYVAGYK

VLPPLMDVNMEAAYTSSLLGSIAGVGWTAGLSSFAAIPFAQSIFYRLN

GVGITQQVLSENQKLIANKFNQALGAMQTGFTTTNEAFRKVQDAVNNN

AQALSKLASELSNTFGAISASIGDIIQRLDVLEQDAQIDRLINGRLTT

LNAFVAQQLVRSESAALSAQLAKDKVNECVKAQSKRSGFCGQGTHIVS

FVVNAPNGLYFMHVGYYPSNHIEVVSAYGLCDAANPTNCIAPVNGYFI

KTNNTRIVDEWSYTGSSFYSPEPITSLNTKYVAPQVTYQNISTNLPPP

LLGNSTGIDFQDELDEFFKNVSTSIPNFGSLTQINTTLLDLTYEMLSL

QQVVKALNESYIDLKELGNYTY.
(GenPept gbAHX00711.1)

Ectodomain minus SP plus altered furin cleavage sites:
[SEQ ID NO: 117]
GPDSVKSACIEVDIQQTFFDKTWPRPIDVSKADGITYPQGRTYSNITI

TY

-continued
SGVYSVSSFEAKPSGSVVEQAEGVECDFSPLLSGTPPQVYNFKRLVFT
NCNYNLTKLLSLFSVNDFTCSQISPAAIASNCYSSLILDYFSYPLSMK
SDLGVSSAGPISQFNYKQSFSNPTCLILATVPHNLTTITKPLKYSYIN
KCSRLLSDDRTEVPQLVNANQYSPCVSIVPSTVWEDGDYYRKQLSPLE
GGGWLVASGSTVAMTEQLQMGFGITVQYGTDTNSVCPKLEFANDTKIA
SQLGNCVEYSLYGVSGRGVFQNCTAVGVRQQRFVYDAYQNLVGYYSDD
GNYYCLRACVSVPVSVIYDKETKTHATLFGSVACEHISSTMSQYSRST
RSMLKRRDSTYGPLQTPVGCVLGLVNSSLFVEDCKLPLGQSLCALPDT
PSTLTP*NSVN*SVPGEMRLASIAFNHPIQVDQFNSSYFKLSIPTNFSFG
VTQEYIQTTIQKVTVDCKQYICNGFQKCEQLLREYGQFCSKINQALHG
ANLRQDDSVRNLFASVKSSQSSPIIPGFGGDFNLTLLEPVSISTGS*NS*
AN*S*AIEDLLFDKVTIADPGYMQGYDDCMQQGPASARDLICAQYVAGYK
VLPPLMDVNMEAAYTSSLLGSIAGVGWTAGLSSFAAIPFAQSIFYRLN
GVGITQQVLSENQKLIANKFNQALGAMQTGFTTTNEAFRKVQDAVNNN
AQALSKLASELSNTFGAISASIGDIIQRLDVLEQDAQIDRLINGRLTT
LNAFVAQQLVRSESAALSAQLAKDKVNECVKAQSKRSGFCGQGTHIVS
FVVNAPNGLYFMHVGYYPSNHIEVVSAYGLCDAANPTNCIAPVNGYFI
KTNNTRIVDEWSYTGSSFYSPEPITSLNTKYVAPQVTYQNISTNLPPP
LLGNSTGIDFQDELDEFFKNVSTSIPNFGSLTQINTTLLDLTYEMLSL
QQVVKALNESYIDLKELGNYTYYNKWPWYIWL.
(GenPept gbAHX00711.1)

2.2.14 VSV G
An exemplary VSV G precursor has the following amino acid sequence:
[SEQ ID NO: 118]
MKCLLYLAFLFIGVNCKFTIVFPHNQKGNWKNVPSNYHYCPSSSDLNW
HNDLIGTAIQVKMPKSHKAIQADGWMCHASKWVTTCDFRWYGPKYITQ
SIRSFTPSVEQCKESIEQTKQGTWLNPGFPPQSCGYATVTDAEAVIVQ
VTPHHVLVDEYTGEWVDSQFINGKCSNYICPTVHNSTTWHSDYKVKGL
CDSNLISMDITFFSEDGELSSLGKEGTGFRSNYFAYETGGKACKMQYC
KHWGVRLPSGVWFEMADKDLFAAARFPECPEGSSISAPSQTSVDVSLI
QDVERILDYSLCQETWSKIRAGLPISPVDLSYLAPKNPGTGPAFTIIN
GTLKYFETRYIRVDIAAPILSRMVGMISGTTTERELWDDWAPYEDVEI
GPNGVLRTSSGYKFPLYMIGHGMLDSDLHLSSKAQVFEHPHIQDAASQ
LPDDESLFFGDTGLSKNPIELVEGWFSSWKSSIASFFFIIGLIIGLFL
VLRVGIHLCIKLKHTKKRQIYTDIEMNRLG
(GenPept gbADX53329.1).

This sequence comprises the following domains/moieties:
SP=1-17
Ectodomain=1-462
MPER=421-462
TM=462-483
C=484-510

Non-limiting examples of VSV G ectodomain polypeptides include:

Ectodomain 1-462:
[SEQ ID NO: 119]
MKCLLYLAFLFIGVNCKFTIVFPHNQKGNWKNVPSNYHYCPSSSDLNW
HNDLIGTAIQVKMPKSHKAIQADGWMCHASKWVTTCDFRWYGPKYITQ
SIRSFTPSVEQCKESIEQTKQGTWLNPGFPPQSCGYATVTDAEAVIVQ
VTPHHVLVDEYTGEWVDSQFINGKCSNYICPTVHNSTTWHSDYKVKGL
CDSNLISMDITFFSEDGELSSLGKEGTGFRSNYFAYETGGKACKMQYC
KHWGVRLPSGVWFEMADKDLFAAARFPECPEGSSISAPSQTSVDVSLI
QDVERILDYSLCQETWSKIRAGLPISPVDLSYLAPKNPGTGPAFTIIN
GTLKYFETRYIRVDIAAPILSRMVGMISGTTTERELWDDWAPYEDVEI
GPNGVLRTSSGYKFPLYMIGHGMLDSDLHLSSKAQVFEHPHIQDAASQ
LPDDESLFFGDTGLSKNPIELVEGWFSSWK.
(GenPept gbADX53329.1)

Ectodomain minus SP:
[SEQ ID NO: 120]
FTIVFPHNQKGNWKNVPSNYHYCPSSSDLNWHNDLIGTAIQVKMPKSH
KAIQADGWMCHASKWVTTCDFRWYGPKYITQSIRSFTPSVEQCKESIE
QTKQGTWLNPGFPPQSCGYATVTDAEAVIVQVTPHHVLVDEYTGEWVD
SQFINGKCSNYICPTVHNSTTWHSDYKVKGLCDSNLISMDITFFSEDG
ELSSLGKEGTGFRSNYFAYETGGKACKMQYCKHWGVRLPSGVWFEMAD
KDLFAAARFPECPEGSSISAPSQTSVDVSLIQDVERILDYSLCQETWS
KIRAGLPISPVDLSYLAPKNPGTGPAFTIINGTLKYFETRYIRVDIAA
PILSRMVGMISGTTTERELWDDWAPYEDVEIGPNGVLRTSSGYKFPLY
MIGHGMLDSDLHLSSKAQVFEHPHIQDAASQLPDDESLFFGDTGLSKN
PIELVEGWFSSWK.
(gbADX53329.1)

Ectodomain minus SP, minus MPER:
[SEQ ID NO: 121]
FTIVFPHNQKGNWKNVPSNYHYCPSSSDLNWHNDLIGTAIQVKMPKSH
KAIQADGWMCHASKWVTTCDFRWYGPKYITQSIRSFTPSVEQCKESIE
QTKQGTWLNPGFPPQSCGYATVTDAEAVIVQVTPHHVLVDEYTGEWVD
SQFINGKCSNYICPTVHNSTTWHSDYKVKGLCDSNLISMDITFFSEDG
ELSSLGKEGTGFRSNYFAYETGGKACKMQYCKHWGVRLPSGVWFEMAD
KDLFAAARFPECPEGSSISAPSQTSVDVSLIQDVERILDYSLCQETWS
KIRAGLPISPVDLSYLAPKNPGTGPAFTIINGTLKYFETRYIRVDIAA
PILSRMVGMISGTTTERELWDDWAPYEDVEIGPNGVLRTSSGYKFPLY
MIGHGMLDSDLHLSSKAQVF.
(GenPept gbADX53329.1)

2.2.15 RABV GP
An exemplary RABV GP precursor has the following amino acid sequence:
[SEQ ID NO: 122]
MIPQTLLFVPLLVFSLCFGKFPIYTIPDKLGPWSPIDIHHLSCPNNLV
VEDEGCTNLSGFSYMELKVGYISAIKVNGFTCTGVVTEAETYTNFVGY
VTTTFKRKHFRPTPDACRAAYNWKMAGDPRYEESLHNPYPDYHWLRTV

```
KTTKESLVIISPSVSDLDPYDKSLHSRVFPSGKCSGITVSSTYCPTNH

DYTIWMPENPRLGTSCDIFTNSRGKRASKGSKTCGFVDERGLYKSLKG

ACKLKLCGVLGLRLMDGTWAAIQTSDEAKWCPPDQLVNIHDFRSDEIE

HLVVEELVKKREECLDALESIMTTKSVSFRRLSHLRKLVPGFGKAYTI

FNKTLMEADAHYKSVRTWNEIIPSKGCLRVGGRCHPHVNGVFFNGIIL

GPDGHVLIPEMQSSLLQQHMELLESSVIPLMHPLADPSTVFKDGDEAE

DFVEVHLPDVHKQVSGVDLGLPSWGKYVLMSVGTLIALMLMILLTTCC

RKANGAESIQHRLGETGRKVSVTSQNGRVISSWESYKSGGETKL.
(GenPept gbAFM52658.1)
```

This sequence comprises the following domains/moieties:
SP=1-20
Ectodomain=1-458
TM=459-478
C=479-524

Non-limiting examples of RABV GP ectodomain polypeptides include:

```
Ectodomain 1-458:
                                        [SEQ ID NO: 123]
MIPQTLLFVPLLVFSLCFGKFPIYTIPDKLGPWSPIDIHHLSCPNNLV

VEDEGCTNLSGFSYMELKVGYISAIKVNGFTCTGVVTEAETYTNFVGY

VTTTFKRKHFRPTPDACRAAYNWKMAGDPRYEESLHNPYPDYHWLRTV

KTTKESLVIISPSVSDLDPYDKSLHSRVFPSGKCSGITVSSTYCPTNH

DYTIWMPENPRLGTSCDIFTNSRGKRASKGSKTCGRIDERGLYKSLKG

ACKLKLCGVLGLRLMDGTWAAIQTSDEAKWCPPDQLVNIHDFRSDEIE

HLVVEELVKKREECLDALESIMTTKSVSFRRLSHLRKLVPGFGKAYTI

FNKTLMEADAHYKSVRTWNEIIPSKGCLRVGGRCHPHVNGVFFNGIIL

GPDGHVLIPEMQSSLLQQHMELLESSVIPLMHPLADPSTVFKDGDEAE

DFVEVHLPDVHKQVSGVDLGLPSWGK.
(GenPept gbAFM52658.1)

Ectodomain minus SP:
                                        [SEQ ID NO: 124]
FPIYTIPDKLGPWSPIDIHHLSCPNNLVVEDEGCTNLSGFSYMELKVG

YISAIKVNGFTCTGVVTEAETYTNFVGYVTTTFKRKHFRPTPDACRAA

YNWKMAGDPRYEESLHNPYPDYHWLRTVKTTKESLVIISPSVSDLDPY

DKSLHSRVFPSGKCSGITVSSTYCPTNHDYTIWMPENPRLGTSCDIFT

NSRGKRASKGSKTCGRIDERGLYKSLKGACKLKLCGVLGLRLMDGTWA

AIQTSDEAKWCPPDQLVNIHDFRSDEIEHLVVEELVKKREECLDALES

IMTTKSVSFRRLSHLRKLVPGFGKAYTIFNKTLMEADAHYKSVRTWNE

IIPSKGCLRVGGRCHPHVNGVFFNGIILGPDGHVLIPEMQSSLLQQHM

ELLESSVIPLMHPLADPSTVFKDGDEAEDFVEVHLPDVHKQVSGVDLG

LPSWGK.
(GenPept gbAFM52658.1)
```

2.2.16 HSV1 Gb
An exemplary HSV1 Gb precursor has the following amino acid sequence:

```
                                        [SEQ ID NO: 125]
MRQGAPARGCRWFVVWALLGLTLGVLVASAAPSSPGTPGVAAATQAAN

GGPATPAPPALGAAPTGDPKPKKNKKPKNPTPPRPAGDNATVAAGHAT

LREHLRDIKAESTDANFYVCPPPTGATVVQFEQPRRCPTRPEGQNYTE

GIAVVFKENIAPYKFKATMYYKDVIVSQVWFGHRYSQFMGIFEDRAPV

PFEEVIDKINAKGVCRSTAKYVRNNLETTAFHRDDHETDMELKPANAA

TRTSRGWHTTDLKYNPSRVEAFHRYGTTVNCIVEEVDARSVYPYDEFV

LATGDFVYMSPFYGYREGSHTEHTSYAADRFKQVDGFYARDLTTKARA

TAPTTRNLLTTPKFTVAWDWVPKRPSVCTMTKWQEVDEMLRSEYGGSF

RFSSDAISTTFTTNLTEYPLSRVDLGDCIGKDARDAMDRIFARRYNAT

HIKVGQPQYYLANGGFLIAYQPLLSNTLAELYVREHLREQSRKPPNPT

PPPPGASANASVERIKTTSSIEFARLQFTYNHIQRHVNDMLGRVAIAW

CELQNHELTLWNEARKLNPNAIASATVGRRVSARMLGDVMAVSTCVPV

AADNVIVQNSMRISSRPGACYSRPLVSFRYEDQGPLVEGQLGENNELR

LTRDAIEPCTVGHRRYFTFGGGYVYFEEYAYSHQLSRADITIVSTFID

LNITMLEDHEFVPLEVYTRHEIKDSGLLDYTEVQRRNQLHDLRFADID

TVIHADANAAMFAGLGAFFEGMGDLGRAVGKVVMGIVGGVVSAVSGVS

SFMSNPFGALAVGLLVLAGLAAAFFAFRYVMRLQSNPMKALYPLTTKE

LKNPTNPDASGEGEEGGDFDEAKLAEAREMIRYMALVSAMEHTEHKAK

KKGTSALLSAKVTDMVMRKRRNTNYTQVPNKDGDADEDDL.
(GenPept gbAAF04615.1)
```

This sequence comprises the following domains/moieties:
SP=1-24
Ectodomain=1-774
TM=775-795
C=796-904

Non-limiting examples of HSV1 Gb ectodomain polypeptides include:

```
Ectodomain 1-774:
                                        [SEQ ID NO: 126]
MRQGAPARGCRWFVVWALLGLTLGVLVASAAPSSPGTPGVAAATQAAN

GGPATPAPPALGAAPTGDPKPKKNKKPKNPTPPRPAGDNATVAAGHAT

LREHLRDIKAESTDANFYVCPPPTGATVVQFEQPRRCPTRPEGQNYTE

GIAVVFKENIAPYKFKATMYYKDVTVSQVWFGHRYSQFMGIFEDRAPV

PFEEVIDKINAKGVCRSTAKYVRNNLETTAFHRDDHETDMELKPANAA

TRTSRGWHTTDLKYNPSRVEAFHRYGTTVNCIVEEVDARSVYPYDEFV

LATGDFVYMSPFYGYREGSHTEHTSYAADRFKQVDGFYARDLTTKARA

TAPTTRNLLTTPKFTVAWDWVPKRPSVCTMTKWQEVDEMLRSEYGGSF

RFSSDAISTTFTTNLTEYPLSRVDLGDCIGKDARDAMDRIFARRYNAT

HIKVGQPQYYLANGGFLIAYQPLLSNTLAELYVREHLREQSRKPPNPT

PPPPGASANASVERIKTTSSIEFARLQFTYNHIQRHVNDMLGRVAIAW

CELQNHELTLWNEARKLNPNAIASATVGRRVSARMLGDVMAVSTCVPV

AADNVIVQNSMRISSRPGACYSRPLVSFRYEDQGPLVEGQLGENNELR

LTRDAIEPCTVGHRRYFTFGGGYVYFEEYAYSHQLSRADITIVSTFID
```

-continued

LNITMLEDHEFVPLEVYTRHEIKDSGLLDYTEVQRRNQLHDLRFADID

TVIHADANAAMFAGLGAFFEGMGDLGRAVGKVVMGIVGGVVSAVSGVS

SFMSNP.
(GenPept gbAAF04615.1)

Ectodomain minus SP 25-775:
[SEQ ID NO: 127]
VLVASAAPSSPGTPGVAAATQAANGGPATPAPPALGAAPTGDPKPKKN

KKPKNPTPPRPAGDNATVAAGHATLREHLRDIKAESTDANFYVCPPPT

GATVVQFEQPRRCPTRPEGQNYTEGIAVVFKENIAPYKFKATMYYKDV

TVSQVWFGHRYSQFMGIFEDRAPVPFEEVIDKINAKGVCRSTAKYVRN

NLETTAFHRDDHETDMELKPANAATRTSRGWHTTDLKYNPSRVEAFHR

YGTIVNCIVEEVDARSVYPYDEFVLATGDFVYMSPFYGYREGSHTEHT

SYAADRFKQVDGFYARDLTTKARATAPTTRNLLTTPKFTVAWDWVPKR

PSVCTMTKWQEVDEMLRSEYGGSFRFSSDAISTTFTTNLTEYPLSRVD

LGDCIGKDARDAMDRIFARRYNATHIKVGQPQYYLANGGFLIAYQPLL

SNTLAELYVREHLREQSRKPPNPTPPPPGASANASVERIKTTSSIEFA

RLQFTYNHIQRHVNDMLGRVAIAWCELQNHELTLWNEARKLNPNAIAS

ATVGRRVSARMLGDVMAVSTCVPVAADNVIVQNSMRISSRPGACYSRP

LVSFRYEDQGPLVEGQLGENNELRLTRDAIEPCTVGHRRYFTFGGGYV

YFEEYAYSHQLSRADITIVSTFIDLNITMLEDHEFVPLEVYTRHEIKD

SGLLDYTEVQRRNQLHDLRFADIDTVIHADANAAMFAGLGAFFEGMGD

LGRAVGKVVMGIVGGVVSAVSGVSSFMSNP.
(GenPept gbAAF04615.1)

An ectodomain polypeptide sequence used to make the chimeric polypeptides of the invention may be found naturally within an enveloped virus fusion protein, and/or it may have one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30) single amino acid mutations (insertions, deletions or substitutions) relative to a natural fusion protein sequence. For instance, it is known to mutate F proteins to eliminate their furin cleavage sequences, thereby preventing intracellular processing. In particular embodiments, the ectodomain polypeptide lacks any one or more of SP, TM and C domains and optionally contains one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30) single amino acid mutations (insertions, deletions or substitutions) relative to a natural fusion protein sequence.

The invention may use any desired enveloped virus fusion protein amino acid sequence, such as the amino acid sequence of SEQ ID NO: 2 to 127, or a sequence having identity or similarity to SEQ ID NO: 2 to 127. Typically it will have at least 75% identity or or similarity to SEQ ID NO: 2 to 127, e.g., at least 80%, at least 85%, at least 90%, at least 95%, at least 97%, at least 98%, at least 99%, identity or similarity to SEQ ID NO: 2 to 127.

2.3 Representative Chimeric Polypeptide Constructs

Non-limiting examples of chimeric polypeptides of the present invention are set out below:

2.3.1 Inf A HA ectodomain-HIV GP160-based SSM
[SEQ ID NO: 128]

MKTIIAFSCILCLIFAQKLPGSDNSMATLCLGHHAVPNGTLVKTITDD

QIEVTNATELVQSSSTGRICNSPHQILDGKNCTLIDALLGDPHCDDFQ

NKEWDLFVERSTAYSNCYPYYVPDYATLRSLVASSGNLEFTQESFNWT

GVAQDGSSYACRRGSVNSFFSRLNWLYNLNYKYPEQNVTMPNNDKFDK

LYIWGVHHPGTDKDQTNLYVQASGRVIVSTKRSQQTVIPNIGSRPWVR

GVSSIISIYWTIVKPGDILLINSTGNLIAPRGYFKIQSGKSSIMRSDA

HIDECNSECITPNGSIPNDKPFQNVNKITYGACPRYVKQNTLKLATGM

RNVPEKQTRGIFGAIAGFIENGWEGMVDGWYGFRHQNSEGTGQAADLK

STQAAINQITGKLNRVIKKTNEKFHQIEKEFSEVEGRIQDLEKYVEDT

KIDLWSYNAELLVALENQHTIDLTDSEMSKLFERTRRQLRENAEDMGN

GCFKIYHKCDNACIGSIRNGTYDHDIYRNEALNNRFQIKGVQLKSGYK

DGGSGIVQQQNNLLRAIEAQQHLLQLTVWGIKQLQARILAGGSGGHTT

WMEWDREINNYTSLIHSLIEESQNQQEKNEQELLE.

2.3.2 Inf A HA stem domain-HIV GP160-based SSM
[SEQ ID NO: 129]

MKTIIALSYILCLVFAQKLPGNDNSTATLCLGHHAVPNGTIVKTITND

QIEVTNATELGFGQNTLKLATGMRNVPEKQTRGIFGAIAGFIENGWEG

MLDGWYGFRHQNSEGRGQAADLKSTQAAIDQINGMLNRLIGSGGSGEL

LVALLNQHTIDLTDSEMNKLFEKTKKQLRENAEDMGNGCFKIYHKCDN

ACIGSIRNGTYDHDVYRDEALNNRFQIKGVELKSGYKDGGRSGIVQQQ

NNLLRAIEAQQHLLQLTVWGIKQLQARILAGGSGGHTTWMEWDREINN

YTSLIHSLIEESQNQQEKNEQELLE.

2.3.3 Inf A H5 ectodomain-HIV GP160-based SSM
[SEQ ID NO: 130]

MGWSCIILFLVATATGVHSEDQICIGYHANNSTEQVDTIMEKNVTVTH

AQDILEKTHNGKLCDLDGVKPLILRDCSVAGWLLGNPMCDEFINVPEW

SYIVEKANPVNDLCYPGDFNDYEELKHLLSRINHFEKIQIIPKSSWSS

HEASLGVSSACPYQGKSSFFRNVVWLIKKNSTYPTIKRSYNNTNQEDL

LVLWGIHHPNDAAEQTKLYQNPTTYISVGTSTLNQRLVPRIATRSKVN

GQSGRMEFFWTILRPNDAINFESNGNFIAPEYAYKIVKKGDSTIMKSE

LEYGNCNAKCQTPMGAINSSMPFHNIHPLTIGECPKYVKSNRLVLATG

LRNSPQRERRRKKRGLFGAIAGFIEGGWQGMVDGWYGYHHSNEQGSGY

AADKESTQKAIDGVTNKVNSIIDKMNTQFEAVGREFNNLERRIENLNK

KMEDGFLDVWTYNAELLVLMENERTLDFHDSNVKNLYDKVRLQLRDNA

KELGNGCFEFYHKCDNECMESVRNGTYDYPQYSEEARLKREEISGVKL

ESIGSGIVQQQNNLLRAIEAQQHLLQLTVWGIKQLQARILAGGSGGHT

TWMEWDREINNYTSLIHSLIEESQNQPAKDEQELLE.

2.3.4 Inf B HA ectodomain-HIV GP160-based SSM
[SEQ ID NO: 131]
MKAIIVLLMVVTSNADRICTGITSSNSPHVVKTATQGEVNVTGVIPLT
TTPTKSHFANLKGTQTRGKLCPNCFNCTDLDVALGRPKCMGNTPSAKV
SILHEVKPATSGCFPIMHDRTKIRQLPNLLRGYENIRLSTSNVINTET
APGGPYKVGTSGSCPNVANGNGFFNTMAWVIPKDNNKTAINPVTVEVP
YICSEGEDQITVWGFHSDDKTQMERLYGDSNPQKFTSSANGVTTHYVS
QIGGFPNQTEDEGLKQSGRIVVDYMVQKPGKTGTIVYQRGILLPQKVW
CASGRSKVIKGSLPLIGEADCLHEKYGGLNKSKPYYTGEHAKAIGNCP
IWVKTPLKLANGTKYRPPAKLLKERGFFGAIAGFLEGGWEGMIAGWHG
YTSHGAHGVAVAADLKSTQEAINKITKNLNYLSELEVKNLQRLSGAMN
ELHDEILELDEKVDDLRADTISSQIELAVLLSNEGIINSEDEHLLALE
RKLKKMLGPSAVEIGNGCFETKHKCNQTCLDRIAAGTFNAGDFSLPTF
DSLNITAASLNDDGLDNHTGGSGIVQQQNNLLRAIEAQQHLLQLTVWG
IKQLQARILAGGSGGHTTWMEWDREINNYTSLIHSLIEESQNQQEKNE
QELLE.

2.3.5 RSV F ectodomain-HIV GP160-based SSM
[SEQ ID NO: 132]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCEIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGKSTTNGGSG
IVQQQNNLLRAIEAQQHLLQLTVWGIKQLQARILA*GGSGG*HTTWMEWD
REINNYTSLIHSLIEESQNQQEKNEQELLE.

2.3.6 RSV F (1-520)-HIV GP160-based SSM:
[SEQ ID NO: 147]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCEIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGK*SGIVQQQN*
*NLLRAIEAQQHLLQLTVWGIKQLQARILAGGSGGHTTWMEWDREINNY*
*TSLIHSLIEESQNQPAKDEQELLE*.

2.3.7 RSV F (1-520)-DScav mutations-HIV GP160-based SSM:
[SEQ ID NO: 150]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVCKVLHLEGEVNKIKSALLSTNKAVVSLSNGVSVLTFKV
LDLKNYIDKQLLPILNKQSCSISNIETVIEFQQKNNRLLEITREFSVN
AGVTTPVSTYMLTNSELLSLINDMPITNDQKKLMSNNVQIVRQQSYSI
MCIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCKIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVNAGK*SGIVQQQN*
*NLLRAIEAQQHLLQLTVWGIKQLQARILAGGSGGHTTWMEWDREINNY*
*TSLIHSLIEESQNQPAKDEQELLE*.

2.3.8 hMPV F ectodomain-HIV GP160-based SSM
[SEQ ID NO: 133]
MSWKVVIIFSLLITPQHGLKESYLEESCSTITEGYLSVLRTGWYTNVF
TLEVGDVENLTCADGPSLIKTELDLTKSALRELRTVSADQLAREEQIE
NPRQSRFVLGAIALGVATAAAVTAGVAIAKTIRLESEVTAIKNALKKT
NEAVSTLGNGVRVLATAVRELKDFVSKNLTRAINKNKCDIADLKMAVS
FSQFNRRFLNVVRQFSDNAGITPAISLDLMTDAELARAVSNMPTSAGQ
IKLMLENRAMVRRKGFGILIGVYGSSVIYMVQLPIFGVIDTPCWIVKA
APSCSEKKGNYACLLREDQGWYCQNAGSTVYYPNEKDCETRGDHVFCD
TAAGINVAEQSKECNINISTTNYPCKVSTGRHPISMVALSPLGALVAC
YKGVSCSIGSNRVGIIKQLNKGCSYITNQDADTVTIDNTVYQLSKVEG
EQHVIKGRPVSSSFDPVKFPEDQFNVALDQVFESIENSQALVDQSNRI
LSSAEKGNTGGSGIVQQQNNLLRAIEAQQHLLQLTVWGIKQLQARILA
GGSGGHTTWMEWDREINNYTSLIHSLIEESQNQQEKNEQELLE.

2.3.9 PIV F ectodomain-HIV GP160-based SSM
[SEQ ID NO: 134]
MPTSILLIITTMIMASFCQIDITKLQHVGVLVNSPKGMKISQNFETRY
LILSLIPKIEDSNSCGDQQIKQYKRLLDRLIIPLYDGLRLQKDVIVSN
QESNENTDPRTKRFFGGVIGTIALGVATSAQITAAVALVEAKQARSDI
EKLKEAIRDTNKAVQSVQSSIGNLIVAIKSVQDYVNKEIVPSIARLGC
EAAGLQLGIALTQHYSELTNIFGDNIGSLQEKGIKLQGIASLYRTNIT
EIFTTSTVDKYDIYDLLFTESIKVRVIDVDLNDYSITLQVRLPLLTRL
LNTQIYKVDSISYNIQNREWYIPLPSHIMTKGAFLGGADVKECIEAFS
SYICPSDPGFVLNHEMESCLSGNISQCPRTVVTSDIVPRYAFVNGGVV
ANCITTTCTCNGIGNRINQPPDQGVKIITHKECNTIGINGMLFNTNKE GTLAFYTPNDITLNNSVALDPIDISIELNKAKSDLEESKEWIRRSNQK
LDSIGNWHQSTT*GGS*GIVQQQNNLLRAIEAQQHLLQLTVWGIKQLQA
RILAGG*SGGH*TTWMEWDREINNYTSLIHSLIEESQNQQEKNEQELLE.

2.3.10 MeV F ectodomain-HIV GP160-based SSM
[SEQ ID NO: 135]
MGLKVNVSAIFMAVLLTLQTPTGQIHWGNLSKIGVVGIGSASYKVMTR
SSHQSLVIKLMPNITLLNNCTRVEIAEYRRLLRTVLEPIRDALNAMTQ
NIRPVQSVASSRRHKRFAGVVLAGAALGVATAAQITAGIALHQSMLNS
QAIDNLRASLETTNQAIEAIRQAGQEMILAVQGVQDYINNELIPSMNQ
LSCDLIGQKLGLKLLRYYTEILSLFGPSLRDPISAEISIQALSYALGG
DINKVLEKLGYSGGDLLGILESRGIKARITHVDTESYLIVLSIAYPTL
SEIKGVIVHRLEGVSYNIGSQEWYTTVPKYVATQGYLISNFDESSCTF
MPEGTVCSQNALYPMSPLLQECLRGSTKSCARTLVSGSFGNRFILSQG
NLIANCASTLCKCYTTGTIINQDPDKILTYIAADHCPVVEVNGVTIQV
GSRRYPDAVYLHRIDLGPPILLERLDVGTNLGNAIAKLEDAKELLESS
DQILRSMKGLSST*GGS*GIVQQQNNLLRAIEAQQHLLQLTVWGIKQLQA
RILAGG*SGGH*TTWMEWDREINNYTSLIHSLIEESQNQQEKNEQELLE.

2.3.11 HeV F ectodomain-HIV GP160-based SSM
[SEQ ID NO: 136]
MATQEVRLKCLLCGIIVLVLSLEGLGILHYEKLSKIGLVKGITRKYKI
KSNPLTKDIVIKMIPNVSNVSKCTGTVMENYKSRLTGILSPIKGAIEL
YNNNTHDLVGDVKLAGVVMAGIAIGIATAAQITAGVALYEAMKNADNI
NKLKSSIESTNEAVVKLQETAEKTVYVLTALQDYINTNLVPTIDQISC
KQTELALDLALSKYLSDLLFVFGPNLQDPVSNSMTIQAISQAFGGNYE
TLLRTLGYATEDFDDLLESDSIAGQIVYVDLSSYYIIVRVYFPILTEI
QQAYVQELLPVSFNNDNSEWISIVPNFVLIRNTLISNIEVKYCLITKK
SVICNQDYATPMTASVRECLTGSTDKCPRELVVSSHVPRFALSGGVLF
ANCISVTCQCQTTGRAISQSGEQTLLMIDNTTCTTVVLGNIIISLGKY
LGSINYNSESIAVGPPVYTDKVDISSQISSMNQSLQQSKDYIKEAQKI
LDTVNPS*GGS*GIVQQQNNLLRAIEAQQHLLQLTVWGIKQLQARILA*GG*
*SGGH*TTWMEWDREINNYTSLIHSLIEESQNQQEKNEQELLE.

2.3.12 NiV F ectodomain-HIV GP160-based SSM
[SEQ ID NO: 137]
MVVILDKRCYCNLLILILMISECSVGILHYEKLSKIGLVKGVTRKYKI
KSNPLTKDIVIKMIPNVSNMSQCTGSVMENYKTRLNGILTPIKGALEI
YKNNTHDLVGDVRLAGVIMAGVAIGIATAAQITAGVALYEAMKNADNI
NKLKSSIESTNEAVVKLQETAEKTVYVLTALQDYINTNLVPTIDKISC
KQTELSLDLALSKYLSDLLFVFGPNLQDPVSNSMTIQAISQAFGGNYE
TLLRTLGYATEDFDDLLESDSITGQIIYVDLSSYYIIVRVYFPILTEI
QQAYIQELLPVSFNNDNSEWISIVPNFILVRNTLISNIEIGFCLITKR
SVICNQDYATPMTNNMRECLTGSTEKCPRELVVSSHVPRFALSNGVLF
ANCISVTCQCQTTGRAISQSGEQTLLMIDNTTCPTAVLGNVIISLGKY
LGSVNYNSEGIAIGPPVFTDKVDISSQISSMNQSLQQSKDYIKEAQRL
LDTVNPS*GGS*GIVQQQNNLLRAIEAQQHLLQLTVWGIKQLQARILA*GG*
*SGGH*TTWMEWDREINNYTSLIHSLIEESQNQQEKNEQELLE.

2.3.13 HIV GP160 ectodomain-RSV F-based SSM
[SEQ ID NO: 138]
MRVMGIERNYPCWWTWGIMILGMIIICNTAENLWVTVYYGVPIWKDAN
TTLFCASDAKAYDTEVHNVWATHACVPTDPSPQELKMENVTEEFNMWK
NNMVEQMHTDIISLWDQSLKPCVQLTPLCVTLDCSYNITNNITNSITN
SSVNMREEIKNCSFNMTTELRDKNRKVYSLFYKLDVVQINNGNNSSNL
YRLINCNTSALTQACPKVTFEPIPIHYCAPAGYAILKCNDKEFNGTGL
CKNVSTVQYTHGIRPVVSTQLLLNGSLAEGKVMIRSENITNNVKNIIV
QLNESVTINCTRPNNNTRRSVRIGPGQTFYATGDIIGDIRQAHCNVSG
SQWNKTLHQVVEQLRKYWNNNTIIFNSSSGGDLEITTHSFNCAGEFFY
CNTSGLFNSTWVNGTTSSMSNGTITLPCRIKQIINMWQRVGQAMYAPP
IQGVIKCESNITGLILTRDGGVNSSDSETFRPGGGDMRDNWRSELYKY
KVVKIEPLGVAPTKARRRVVEREKRAVTLGAVFIGFLGTAGSTMGAVS
ITLTVQARKLLSGIVQQQSNLLRAIEAQQHLLKLTVWGIKQLQARVLA
VERYLRDQQLLGIWGCSGKLICPTNVPWNSSWSNKSLDEIWENMTWLQ
WDKEISNYTIKIYELIEESQIQQERNEKDLLELDKWASLWNWFDISKW
LWYIK*GGG*VNKIKSALLSTNKAVVSLSNGVSVLTSKVLDLK*GGGGHHH*
*HGGG*FDASISQVNEKINQSLAFIRKSDELLHNV.

2.3.14 EBOV GP ectodomain minus mucin like
domain (1-311, 462-650)-HIV GP160-based SSM
[SEQ ID NO: 139]
MGVTGILQLPRDRFKRTSFFLWVIILFQRTFSIPLGVIHNSTLQVSDV
DKLVCRDKLSSTNQLRSVGLNLEGNGVATDVPSATKRWGFRSGVPPKV
VNYEAGEWAENCYNLEIKKPDGSECLPAAPDGIRGFPRCRYVHKVSGT
GPCAGDFAFHKEGAFFLYDRLASTVIYRGTTFAEGVVAFLILPQAKKD
FFSSHPLREPVNATEDPSSGYYSTTIRYQATGFGTNETEYLFEVDNLT
YVQLESRFTPQFLLQLNETIYTSGKRSNTTGKLIWKVNPEIDTTIGEW
AFWETKKNLTRKIRSEELSFTVV*GG*NNTHHQDTGEESASSGKLGLITN
TIAGVAGLITGGRRTRREAIVNAQPKCNPNLHYWTTQDEGAAIGLAWI
PYFGPAAEGIYIEGLMHNQDGLICGLRQLANETTQALQLFLRATTELR
TFSILNRKAIDFLLQRWGGTCHILGPDCCIEPHDWTKNITDKIDQIIH
DFVDKTLPDQGDNDNWWTGWRQ*GGS*GIVQQQNNLLRAIEAQQHLLQT
VWGIKQLQARILA*GGSGGH*TTWMEWDREINNYTSLIHSLIEESQNQQE
KNEQELLE.

2.3.15 MARV GP ectodomain, minus mucin like
domain-HIV GP160-based SSM
[SEQ ID NO: 140]
MKTTCFLISLILIQGTKNLPILEIASNNQPQNVDSVCSGTLQKTEDVH
LMGFTLSGQKVADSPLEASKRWAFRTGVPPKNVEYTEGEEAKTCYNIS
VTDPSGKSLLLDPPTNIRDYPKCKTIHHIQGQNPHAQGIALHLWGAFF
LYDRIASTTMYRGKVFTEGNIAAMIVNKTVHKMIFSRQGQGYRHMNLT
STNKYWTSSNGTQTNDTGCFGALQEYNSTKNQTCAPSKIPPPLPTARP
EIKL*GGA*QHLVYFRRKRSILWREGDMFPFLDGLINAPIDFDPVPNTKT IFDESSSSGASAEEDQHASPNISLTLSYFPNINENTAYSGENENDCDA
ELRIWSVQEDDLAAGLSWIPFFGPGIEGLYTAVLIKNQNNLVCRLRRL
ANQTAKSLELLLRVTTEERTFSLINRHAIDFLLTRWGGTCKVLGPDCC
IGIEDLSKNISEQIDQIKKDEQKEGTGWGLGGKWWTSDW*GGSG*IVQQQ
NNLLRAIEAQQHLLQLTVWGIKQLQARILA*GGSGG*HTTWMEWDREINN
YTSLIHSLIEESQNQQEKNEQELLE.

2.3.16 SARS-CoV S ectodomain-HIV GP160-based SSM
[SEQ ID NO: 141]
MFIFLLFLTLTSGSDLDRCTTFDDVQAPNYTQHTSSMRGVYYPDEIFR
SDTLYLTQDLFLPFYSNVTGFHTINHTFGNPVIPFKDGIYFAATEKSN
VVRGWVFGSTMNNKSQSVIIINNSTNVVIRACNFELCDNPFFAVSKPM
GTQTHTMIFDNAFNCTFEYISDAFSLDVSEKSGNFKHLREFVFKNKDG
FLYVYKGYQPIDVVRDLPSGFNTLKPIFKLPLGINITNFRAILTAFSP
AQDIWGTSAAAYFVGYLKPTTFMLKYDENGTITDAVDCSQNPLAELKC
SVKSFEIDKGIYQTSNFRVVPSGDVVRFPNITNLCPFGEVFNATKFPS
VYAWERKKISNCVADYSVLYNSTFFSTFKCYGVSATKLNDLCFSNVYA
DSFVVKGDDVRQIAPGQTGVIADYNYKLPDDFMGCVLAWNTRNIDATS
TGNYNYKYRYLRHGKLRPFERDISNVPFSPDGKPCTPPALNCYWPLND
YGFYTTTGIGYQPYRVVVLSFELLNAPATVCGPKLSTDLIKNQCVNFN
FNGLTGTGVLTPSSKRFQPFQQFGRDVSDFTDSVRDPKTSEILDISPC
AFGGVSVITPGTNASSEVAVLYQDVNCTNVSAAIHADQLTPAWRIYST
GNNVFQTQAGCLIGAEHVDTSYECDIPIGAGICASYHTVSLLRSTSQK
SIVAYTMSLGADSSIAYSNNTIAIPTNFSISITTEVMPVSMAKTSVDC
NMYICGDSTECANLLLQYGSFCTQLNRALSGIAAEQDRNTREVFAQVK
QMYKTPTLKYFGGFNFSQILPDPLKPTKRSFIEDLLFNKVTLADAGFM
KQYGECLGDINARDLICAQKFNGLTVLPPLLTDDMIAAYTAALVSGTA
TAGWTFGAGAALQIPFAMQMAYRFNGIGVTQNVLYENQKQIANQFNKA
ISQIQESLTTTSTALGKLQDVVNQNAQALNTLVKQLSSNFGAISSVLN
DILSRLDKVEAEVQIDRLITGRLQSLQTYVTQQLIRAAEIRASANLAA
TKMSECVLGQSKRVDFCGKGYHLMSFPQAAPHGVVFLHVTYVPSQERN
FTTAPAICHEGKAYFPREGVFVFNGTSWFITQRNFFSPQIITTDNTFV
SGNCDVVIGIINNWYDPLQPELDSFKGELDKYFKNHTSPDVDLGDISG
INASVVNIQKEIDRLNEVAKNLNESLIDLQELGKYEQYIKWPWYVW*GG*
*SG*IVQQQNNLLRAIEAQQHLLQLTVWGIKQLQARILA*GGSGG*HTTWME
WDREINNYTSLIHSLIEESQNQQEKNEQELLE.

2.3.17 MERS-CoV S ectodomain-HIV GP160-based SSM
[SEQ ID NO: 142]
MIHSVFLLMFLLTPTESYVDVGPDSVKSACIEVDIQQTFFDKTWPRPI
DVSKADGIIYPQGRTYSNITITYQGLFPYQGDHGDMYVYSAGHATGTT
PQKLFVANYSQDVKQFANGFVVRIGAAANSTGTVIISPSTSATIRKIY
PAFMLGSSVGNFSDGKMGRFFNHTLVLLPDGCGTLLRAFYCILEPRSG
NHCPAGNSYTSFATYHTPATDCSDGNYNRNASLNSFKEYFNLRNCTFM
YTYNITEDEILEWFGITQTAQGVHLFSSRYVDLYGGNMFQFATLPVYD TIKYYSIIPHSIRSIQSDRKAWAAFYVYKLQPLTFLLDFSVDGYIRRA
IDCGFNDLSQLHCSYESFDVESGVYSVSSFEAKPSGSVVEQAEGVECD
FSPLLSGTPPQVYNFKRLVFTNCNYNLTKLLSLFSVNDFTCSQISPAA
IASNCYSSLILDYFSYPLSMKSDLGVSSAGPISQFNYKQSFSNPTCLI
LATVPHNLTTITKPLKYSYINKCSRLLSDDRTEVPQLVNANQYSPCVS
IVPSTVWEDGDYYRKQLSPLEGGGWLVASGSTVAMTEQLQMGFGITVQ
YGTDTNSVCPKLEFANDTKIASQLGNCVEYSLYGVSGRGVFQNCTAVG
VRQQRFVYDAYQNLVGYYSDDGNYYCLRACVSVPVSVIYDKETKTHAT
LFGSVACEHISSTMSQYSRSTRSMLKRRDSTYGPLQTPVGCVLGLVNS
SLFVEDCKLPLGQSLCALPDTPSTLTPRSVRSVPGEMRLASIAFNHPI
QVDQFNSSYFKLSIPTNFSFGVTQEYIQTTIQKVTVDCKQYICNGFQK
CEQLLREYGQFCSKINQALHGANLRQDDSVRNLFASVKSSQSSPIIPG
FGGDFNLTLLEPVSISTGSRSARSAIEDLLFDKVTIADPGYMQGYDDC
MQQGPASARDLICAQYVAGYKVLPPLMDVNMEAAYTSSLLGSIAGVGW
TAGLSSFAAIPFAQSIFYRLNGVGITQQVLSENQKLIANKFNQALGAM
QTGFTTTNEAFRKVQDAVNNNAQALSKLASELSNTFGAISASIGDIIQ
RLDVLEQDAQIDRLINGRLTTLNAFVAQQLVRSESAALSAQLAKDKVN
ECVKAQSKRSGFCGQGTHIVSFVVNAPNGLYFMHVGYYPSNHIEVVSA
YGLCDAANPTNCIAPVNGYFIKTNNTRIVDEWSYTGSSFYSPEPITSL
NTKYVAPQVTYQNISTNLPPPLLGNSTGIDFQDELDEFFKNVSTSIPN
FGSLTQINTTLLDLTYEMLSLQQVVKALNESYIDLKELGNYTYYNKWP
WYIWL*GGS*GIVQQQNNLLRAIEAQQHLLQLTVWGIKQLQARILA*GGSG*
*G*HTTWMEWDREINNYTSLIHSLIEESQNQQEKNEQELLE.

2.3.18 VSV G ectodomain-HIV GP160-based SSM
[SEQ ID NO: 143]
MKCLLYLAFLFIGVNCKFTIVFPHNQKGNWKNVPSNYHYCPSSSDLNW
HNDLIGTAIQVKMPKSHKAIQADGWMCHASKWVTTCDFRWYGPKYITQ
SIRSFTPSVEQCKESIEQTKQGTWLNPGFPPQSCGYATVTDAEAVIVQ
VTPHHVLVDEYTGEWVDSQFINGKCSNYICPTVHNSTTWHSDYKVKGL
CDSNLISMDITFFSEDGELSSLGKEGTGFRSNYFAYETGGKACKMQYC
KHWGVRLPSGVWFEMADKDLFAAARFPECPEGSSISAPSQTSVDVSLI
QDVERILDYSLCQETWSKIRAGLPISPVDLSYLAPKNPGTGPAFTIIN
GTLKYFETRYIRVDIAAPILSRMVGMISGTTTERELWDDWAPYEDVEI
GPNGVLRTSSGYKFPLYMIGHGMLDSDLHLSSKAQVFEHPHIQDAASQ
LPDDESLFFGDTGLSKNPIELVEGWFSSWK*GGS*GIVQQQNNLLRAIEA
QQHLLQLTVWGIKQLQARILA*GGSGG*HTTWMEWDREINNYTSLIHSLI
EESQNQQEKNEQELLE.

2.3.19 RABV GP ectodomain-HIV GP160-based SSM
[SEQ ID NO: 144]
MIPQTLLFVPLLVFSLCFGKFPIYTIPDKLGPWSPIDIHHLSCPNNLV
VEDEGCTNLSGFSYMELKVGYISAIKVNGFTCTGVVTEAETYTNFVGY
VTTTFKRKHFRPTPDACRAAYNWKMAGDPRYEESLHNPYPDYHWLRTV -continued

```
KTTKESLVIISPSVSDLDPYDKSLHSRVFPSGKCSGITVSSTYCPTNH

DYTIWMPENPRLGTSCDIFTNSRGKRASKGSKTCGRIDERGLYKSLKG

ACKLKLCGVLGLRLMDGTWAAIQTSDEAKWCPPDQLVNIHDFRSDEIE

HLVVEELVKKREECLDALESIMTTKSVSFRRLSHLRKLVPGFGKAYTI

FNKTLMEADAHYKSVRTWNEIIPSKGCLRVGGRCHPHVNGVFFNGIIL

GPDGHVLIPEMQSSLLQQHMELLESSVIPLMHPLADPSTVFKDGDEAE

DFVEVHLPDVHKQVSGVDLGLPSWGKGGSGIVQQQNNLLRAIEAQQHL

LQLTVWGIKQLQARILAGGSGGHTTWMEWDREINNYTSLIHSLIEESQ

NQQEKNEQELLE.
```

2.3.20 HSV1 Gb ectodomain-HIV GP160-based SSM [SEQ ID NO: 145]

```
MRQGAPARGRRWFVVWALLGLTLGVLVVSAAPSSPGTPGVAAATQAAN

GGPATPAPPAPGAPPTGDPKPKKNKKPKPPKPPRPAGDNATVAAGHAT

LREHLRDIKAENTDANFYVCPPPTGATVVQFEQPRRCPTRPEGQNYTE

GIAVVFKENIAPYKFKATMYYKDVTVSQVWFGHRYSQFMGIFEDRAPV

PFEEVIDKINAKGVCRSTAKYVRNNLETTAFHRDDHETDMELKPANAA

TRTSRGWHTTDLKYNPSRVEAFHRYGTTVNCIVEEVDARSVYPYDEFV

LATGDFVYMSPFYGYREGSHTEHTSYAADRFKQVDGFYARDLTTKARA

TAPTTRNLLTTPKFTVAWDWVPKRPSVCTMTKWQEVDEMLRSEYGGSF

RFSSDAISTTFTTNLTEYPLSRVDLGDCIGKDARDAMDRIFARRYNAT

HIKVGQPQYYLANGGFLIAYQPLLSNTLAELYVREHLREQSRKPPNPT

PPPPGASANASVERIKTTSSIEFARLQFTYNHIQRHVNDMLGRVAIAW

CELQNHELTLWNEARKLNPNAIASATVGRRVSARMLGDVMAVSTCVPV

AADNVIVQNSMRISSRPGACYSRPLVSFRYEDQGPLVEGQLGENNELR

LTRDAIEPCTVGHRRYFTFGGGYVYFEEYAYSHQLSRADITTVSTFID

LNITMLEDHEFVPLEVYTRHEIKDSGLLDYTEVQRRNQLHDLRFADID

TVIHADANAAMFAGLGAFFEGMGDLGRAVGKVVMGIVGGVVSAVSGVS

SFMSNPGGSGIVQQQNNLLRAIEAQQHLLQLTVWGIKQLQARILAGGS

GGHTTWMEWDREINNYTSLIHSLIEESQNQQEKNEQELLE.
```

2.4 Use of Structure-Stabilizing Moiety as a Universal Oliqomerization Domain In addition to its utility in stabilizing an ectodomain polypeptide of the invention against rearrangement to a post-fusion conformation, the structure-stabilizing moiety is useful as a universal oligomerization domain (UOD) for oligomerizing any heterologous molecules of interest into oligomers, particularly trimers. In specific embodiments, a UOD is fused upstream or downstream of a heterologous proteinaceous molecule to form a chimeric polypeptide. Typically, the UOD is fused downstream of the heterologous proteinaceous molecule. As with the ectodomain embodiments described herein, association of the complementary heptad repeats of the UOD to one another under conditions suitable for their association (e.g., in aqueous solution) results in formation of an anti-parallel, two-helix bundle that trimerizes to form a highly stable six-helix bundle, thus permitting trimerization of the chimeric polypeptide to form a trimeric polypeptide complex.

The heterologous proteinaceous molecule may be a natural or non-natural polypeptide. In certain embodiments, the heterologous polypeptide is or comprises a therapeutic polypeptide. A vast variety of therapeutic polypeptides, including both ligands and receptors, are known in the art to be useful for treating a variety of diseases. Various examples of known targets and indications for therapeutic polypeptides are shown in Table 8.

TABLE 8

| PEPTIDE TARGET | INDICATION | NAME/COMPANY |
|---|---|---|
| | Oncology | |
| GNRH receptor | Palliative prostate cancer treatment | Leuprorelin/Takeda Histrelin/Valera Goserelin/AstraZeneca |
| CXCR4 antagonist | Stem cell mobilizer, NHL, MM | Mozobil/AnorMED Inc (now Genzyme) |
| | Hepatocellular Carcinoma | CTCE-9908/Chemokine Therapeutics |
| Integrin alphaV-beta 3 antagonist | Head and Neck, glioblastoma | Cilengitide/Merck |
| Angiopoietin receptor kinase antagonist | Breast, ovarian, renal cell carcinoma | AMG-386 peptibody/Amgen, Takeda |
| IGF1-R antagonist | Hepatocellular Carcinoma | Allostera Pharmaceuticals |
| Gastrin-releasing peptide receptor bFGF | Inflammation, Cancer, Anti-angiogenesis various cancers | Academic |
| Gelatinase inhibitor | Cancer | CTT Technologies |
| GCSFR agonist | Neutropenia | Gematide/Affymax |
| Keratinocyte GFR | Mucositis | Keratide/Affymax |
| VEGF-R2/c-met receptor | Cancer | Dipeptide from Dyax |
| | Autoimmune | |
| TPO | ITP | Nplate peptibody/Amgen |
| GLP-2 analog | Crohn's Enterocolitis | Teduglutide/NPS Allelix |
| Treg | MS | Copaxone/Teva |
| GPCR agonists | Various | Compugen |
| | Diabetes | |
| GLP-1 analogues/R agonists | | GLP-1 (7-37)/Biorexis Pfizer Exenatide/Amylin Liraglutide/Novo Nordisk ZP10/Zealand Pharma/Sanofi-Avanetis Pramlinitide/Amylin |
| Proislet peptide | | CureDM |
| Glucagon antagonist | | Glucagon |
| | Obesity | PYY/multiple companies Oxyntomodulin TKS-1225/Thiakis/Wyeth |
| Oxyntomodulin EPO | Anemic chronic kidney disease | Hematide/Affimax |
| Calcitonin PH receptor | Osteoporosis | Capsitonin/Bone Medical Teriparatide/Lilly |
| | Cardiovascular | |
| BNP | Congestive heart failure | Nesiritide/Scios |
| GIIb/IIIa antagonist | Myocardial infarction | Eptifibatide/COR Therapeutics/Schering Plough |
| Thrombin inhibitor | Thrombosis, Ischemic heart disease | Bivalirudin/TMC/Scherrer |
| Bradykinin B2 antagonist | Hereditary angioedema | Icatibant/Hoechst |
| GAP junction modulator | Heart Arrhythmia | Rotigaptide/Zealand/Wyeth |
| FPLRG1 agonist | Reperfusion injury | Compugen |
| BNP/ANP | Congestive heart failure | Bispecific/Academic |
| | Acromegaly | |
| Somatostatin receptor agonist | Acromegaly and neuroendocrine cancer | Octreotide/Valera Pharmaceuticals Lanreotide/Ibsen |
| | Enuresis | |
| Vasopressin V1 agonist | | Desmopressin/Orphan Therapeutics/Lypressin Terlipressin/Orphan Therapeutics |
| | Labor | |

TABLE 8-continued

| PEPTIDE TARGET | INDICATION | NAME/COMPANY |
| --- | --- | --- |
| Oxytocin antagonist | Halts Premature Labor | Retosiban/GSK/ Atosiban/Ferring |
| | Antiviral | |
| HIV fusion protein blocker | HIV | Enfuviritide/Roche |
| Immunostimulatory | HepC, Hep C | Thymalfasin/RegeneRx SCV-07/SciClone |
| CXCR4 antagonist | HIV | AnorMED Inc (now Genzyme) |
| CCR5 antagonist | HIV | |
| CXCR4/CCR5 bispecific | HIV | Genzyme |
| | Antibacterial | |
| | Staph. Aureus | Daptamycin Bacitracin Gramidicin/ |
| | Ophthalmic | Bausch&Lomb Colistin Pexiganan Omiganan |
| | Staph. Aureus | Xoma-629 |
| Glycophorin antagonist | Malaria | Academic |
| | CNS | |
| Norepinephrine transporter antagonist | Severe chronic pain | Conotoxin/Xenome |
| | Antidepressant | Nemifitide |
| Formyl peptide receptor-like 1 agonists/antagonists | COPD | Various academics, Bayer 2003 patent |
| IL4/IL 13 antagonist | Asthma | Synairgen Academic |
| Prokineticin receptor-1 and-2 | | |

The UOD of the invention can be used to create trimerized soluble receptors including for example TNF receptor superfamily members, Ig superfamily members, cytokine receptor superfamily members, chemokine receptor superfamily members, integrin family members, growth factor receptor family, hormone receptors, opioid receptors, other neuropeptide receptors, ion channels, among others, including CD1a-e, CD2 (LFA-2), CD2R, CD3γ, CD3δ, CD3ε, CD4-7, CD8a, CD8b, CD9, CD10 CD11a, CD11b, CD11c, CDwl2, CD13, CD14, CD15, CD15s, CD15u, CD16a (FcγRIIIA), CD16b (FcγRIIIB), CDw17, CD18 (Integrin 132), CD19-28, CD29 (Integrin 131), CD30, CD31 (PE-CAM-1), CD32 (FcγRII), CD33 (Siglec-3), CD34-41, CD42a-d, CD43, CD44, CD44R, CD45, CD45RA, CD45RB, CD45RO, DC47, CD47R, CD48, CD49a-f (VLA-1-6), CD50 (ICAM-3), CD51, CD52, CD53, CD54 (ICAM-1), CD55, CD56 (N-CAM), CD57, CD58 (LFA-3), CD59, CD60a-c, CD61, CD62E, CD62L, CD62P, CD63, CD64, CD65, CD65s, CD66a-f, CD68, CD69, CD70, CD71, CD72, CD73, CD74, CD75, CD75s, CD77, CD79a, CD79b, CD80, CD81, CD82, DC83, CDw84, CD85, CD86-CD91, CDw92, CD93, CD94-CD99, CD99R, CD100-CD106, CD107a, CD107b, CD108-CD112, CDw113, CD114 (G-CSFR), CD115 (M-CSFR), CD116, CD117, CD118. CDw119, CD120a, CD120b, CD121a (IL-1R type I), CDw121b (IL-1R, type II), CD122 (IL-2R3), CDw123 (IL-3R), CD124 (IL-4R), CDw125 (IL-5R), CD126 (IL-6R), CD127 (IL-7R), CDw128, CDw128b (IL-8Rβ), CD129 (IL-9R), CD130 (IL-6Rβ), CDw131, CD132, CD133, CD134 (Ox-40), CD135-CD139, CD140a (PDGFRα), CD140b (PDGFRβ), CD141-CD144, CDw145, CD146, CD147, CD148, CD15, CD151, CD152 (CTLA-4), CD153 (CD30L), CD154 (CD40L), CD155, CD156a-c, CD157, CD158a, CD158b, CD159a, CD159c, CD160, CD161, CD162, CD162R, CD163, CD164, CD165, CD166, CD167a, CD168, CD169, CD170, CD171, CD172a, CD172b, CD172g, CD173, CD174, CD175, CD175s, CD176, CD178 (FasL), CD179a, CD179b, CD180, CD181 (CXCR1), CD182 (CXCR2), CD183 (CXCR3), CD184 (CXCR4), CD185 (CXCR5), CDw186 (CXCR6), CD191 (CCR-1), CD192 (CCR2), CD193 (CCR3), CD194 (CCR4), CD195 (CCR5). CD196 (CCR6), CD197 (CCR7), CDw198 (CCR8), CDwl99 (CCR9), CD200 (Ox-2), CD201, CD202b, CD203c, CD204 (macrophage scavenger R), CD207 (Langerin), CD208 (DC-LAMP), CD209 (DC-SIGN), CDw210 (IL-10R), CD212 (IL-12-Rβ1), CD213a1 (IL-13-Rα1), CD213a2 (IL-13-Rα2), CDw217 (IL-17-R), CDw218a (IL-18Rα), CDw218b (IL-18R3), CD220 (Insulin-R), CD221 (IGF-1R), CD222 (IGF-II R), CD223-234, CD235a (glycophorin A), CD235ab (glycophorin A/B), CD235b (glycophorin B), CD236 (glycophorin C/D), CD236R (glycophorin C), CD238, CD239, CD240CE, CD240D, CD241-CD249, CD252 (Ox40L), CD254 (RANKL), CD256 (APRIL), CD257 (BAFF), CD258 (LIGHT), CD261 (TRAIL-R1), CD262 (TRAIL-R2), CD263 (DcR1), CD264 (DcR2), CD256 (RANK), CD266 (TWEAK-R), CD267 (TACI), CD268 (BAFFR), CD269 (BCMA), CD271 (NGFR), CD272 (BTLA), CD273 (PD-L2), CD274 (PD-L1), CD275 (B7-H2), CD276 (B7-H3), CD277, CD278 (ICOS), CD279 (PD1), CD280, CD281 (TLR1), CD282 (TLR2), CD283 (TLR3), CD284 (TLR4), CD289 (TLR9), CD292, CDw293, CD294, CD295 (Lept-inR), CD296, CD297, CD298 (Na+/K+-ATPase β3 subunit), CD299 (L-SIGN), CD300a, CD300c, CD300e, CD301-CD307, CD309 (VEGF-R2), CD312, CD314-322, CD324, CDw325, CD326, CDw327, CDw328, CDw329, CD331-CD337, CDw338, CD339, B7-H4, Xedar, CCR10, CCR11, CX3CR1, chemokine-like receptor-1 (ChemR23), complement receptors, DARC, IL-11R, IL-12R, IL-13R, IL-15R, IL-20R, IL-21R, IL-22R, IL-23R, IL-27R, IL-28R, IL-31R, XCR1, CX3CR1, chemokine-binding protein 2 (D6), interferon receptors, leukocyte associated Ig-like receptor family, leukocyte immunoglobulin-like receptor family including LILRC1 and LILRC2, leukotriene receptors, LAMP, nectin-like proteins 1-4, IgSF8, immunoglobulin-like transcript family LT1-6, EDAR, stromal derived factor (SDF), thymic stromal lymphopoietin receptor, erythropoietin receptor, thrombopoietin-receptor, epidermal growth factor receptor, fibroblast growth factor receptors FGF1-4, hepatocyte growth factor receptor (HGF-R), epaCAM, insulin-like growth factor receptors IGF1-R and IGF2-R, fibronectin, fibronectin leucine-rich transmembrane proteins FLRT1-3, Her2, 3 and 4, CRELD1 and 2, 8D6A, lipoprotein receptor (LDL-R), C-type lectin-like family members such as CLEC-1, CLEC-2, CLEC4D, 4F and Dectin 1 and 2, layilin, growth hormone receptor, prolactin-releasing hormone receptor (PRRP), corticotropin-releasing hormone receptors (CRHR), follicle stimulating hormone receptor (FSHR), gonadotropin-releasing hormone receptor (GNRHR), thyrotropin-releasing hormone receptor (TRHR), somatostatin receptors SSTR1-SSTR5, vasopressin receptors 1A, 1B, 2, Oxytocin receptor, luteinizing hormone/choriogonadotropin receptor (LHCGR), thyrotropin receptor, atrial natriuretic factor receptor NPR1-3, acetylcholine receptors (AChR), calcitonin receptor (CT), Cholecystokinin receptors CCKAR and CCKBR, vasoactive intestinal peptide receptors VPAC1 and 2, δ-opioid receptors, κ-opioid receptors, μ-opioid receptors, σ receptors σ1 and σ, cannabinoid receptors R1 and 2, angiotensin receptors AT1-4, bradykinin receptors V1 and 2, tachykinin receptor 1 (TACR1), calcitonin receptor-like receptor (CRLR), galanin receptors R1-3, GPCR neuropeptide receptors neuropeptide B/W R1 and 2, neuropeptide FF receptors R1 and R2, neuropeptide S receptor R1, neuropeptide Y receptors Y1-5, neurotensin receptors, Type I and II activin receptors, activin receptor-like kinases (Alk-1 and Alk-7), betaglycan, BMP and Activin membrane bound inhibitor (BAMBI), cripto, Trk receptors TrkA, TrkB, TrkC, AXL receptor family, LTK receptor family, TIE-1, TIE-2, Ryk, Neuropilin 1, Eph receptors EPHA1, EPHA2, EPHA3, EPHA4, EPHA5, EPHA6, EPHA7, EPHA8, EPHA9, EPHA10, EPHB1, EPHB2, EPHB3, EPHB4, EPHB5, EPHB6, melanocortin receptors MC-3 and MC-4, AMICA, CXADR, corticotrophin-releasing hormone-binding protein, Class-I restricted T cell-associated molecule, MHCI, MHCII, ampoterin-induced gene and ORF (AMIGOs), APJ, asialoglycoprotein receptors 1 and 2 (ASGPR), brain-specific angiogenesis inhibitor 3 (BAI-3), basal cell adhesion molecule/Lutheran blood group glycoprotein (BCAM/Lu), cadherins, CDCP1, cystic fibrosis transmembrane conductance regulator MRP-7, chondrolectin, lung surfactin, claudins, ANTHXR2, collagens, complement receptors, contactins 1-6, cubulin, endoglycan, EpCAM (epithelial cellular adhesion molecule), Endothelial Protein C receptor (EPCR), Eph receptors, glucagon-like peptide receptors GLP-1R and 2R, glutamate receptors, glucose transporters, glycine receptor, glypicans, G-protein coupled bile acid receptor, G-protein coupled receptor 15, KLOTHO family members, leptin receptor, LIMPII, LINGO, NOGO, lymphatic bessel endothelial hyaluronan receptor 1 (LYVE-1), myeloid inhibitory C-type lectin-like receptor CLEC12A, neogenin, nephrin, NETO-1, NETO-2, NMDA receptor, opioid-binding cell adhesion molecule, osteoclast inhibitory lectin-related protein, oncostatin receptor, osteoclast associated receptor, osteoactivin, thrombin receptors, podoplanin, porimin, potassium channels, Pref-1, stem cell factor receptor, semaphorins, SPARC, scavenger receptor A1, stabilins, syndecans, T cell receptors, TCAM-1, T cell cytokine receptor TCCR, thrombospondins, TIM1-6, toll-like receptors, triggering receptors expressed on myeloid cells (TREM) and TREM-like proteins, TROP-2 or any mimetic or analog thereof.

Furthermore, the UOD of the invention can be used to trimerize ligands of any of the above receptors including for example TNF superfamily members, cytokine superfamily members, growth factors, chemokine superfamily members, pro-angiogenic factors, pro-apoptotic factors, integrins, hormones and other soluble factors, among others, including RANK-L, Lymphotoxin (LT)-α, LT-β, LT-α1β2, zLIGHT, BTLA. TL1A, FasL, TWEAK, CD30L, 4-1BB-L (CD137L), CD27L, Ox40L (CD134L), GITRL, CD40L (CD154), APRIL (CD256), BAFF, EDA1, IL-1α, IL-1β, IL-1RA, IL-2, IL-3, IL-4, IL-5, IL-6, IL-7, IL-8, IL-9, IL-10, IL-11, IL-12, IL-13, IL-14, IL-15, IL-16, IL-17A, IL-17F, IL-17A/F, IL-18, IL-1 g, IL-20, IL-21, IL-22, IL-23, IL-24, IL-25, IL-26, IL-27, IL-28, IL-29, IL-30, IL-31, IL-32, IL-33, IL-34, IL-35, IFN-gamma, IFN-alpha, IFN-beta, TNF-α, TNF-β, G-CMF, GM-CSF, TGF-β1, 2 and 3, TGF-α, cardiotrophin-1, leukemia inhibitory factor (LIF), betacellulin, amphiregulin, thymic stromal lymphopoietin (TSLP), flt-3, CXCL1-16, CCL1-3, CCL3L1, CCL4-CCL8, CCL9/10, CCL11-28, XCL1, XCL2, CX3CL1, HMG-B1, heat shock proteins, chemerin, defensins, macrophage migration inhibitory factor (MIF), oncostatin M, limitin, vascular endothelial growth factors VEGF A-D and PlGF, lens epithelium derived growth factor, erythropoietin, thrombopoietin, platelet derived growth factor, epidermal growth factor, fibroblast growth factors FGF1-14 and 16-23, hepatoma-derived growth factor, hepassocin, hepatocyte growth factor, platelet-derived endothelial growth factor (PD-ECGF), insulin-like growth factors IGF1 and IGF2, IGF binding proteins (IGFBP 1-6), GASPS (growth and differentiation-factor-associated serum proteins), connective tissue growth factor, epigen, epiregulin, developmental arteries and neural crest epidermal growth factor (DANCE), glial maturation factor-β, insulin, growth hormone, angiogenin, angiopoietin 1-4, angiopoietin-like proteins 1-4, integrins αVβ3, αVβ5 and α5β1, erythropoietin, thrombopoietin, prolactin releasing hormone, corticotropin-releasing hormone (CRH), gonadotropin releasing hormone, thyrotropin releasing hormone, somatostatin, vasopressin, oxytocin, demoxytocin, carbetocin, luteinizing hormone (LH) and chorionic gonadotropins, thyroid-stimulating hormone, ANP, BNP, CNP, calcitonin, CCK a, CCK B, vasoactive intestinal peptides 1 and 2, encephalin, dynorphin, β-endorphin, morphine, 4-PPBP, [1] SA 4503, Ditolylguanidine, siramesine angiotensin, kallidin, bradykinin, tachykinins, substance P, calcitonin, galanin, neurotensin, neuropeptides Y1-5, neuropeptide S, neuropeptide FF, neuropeptide B/W, brain-derived neurotrophic factors BDNF, NT-3, NT-4/5, activin A, AB, B and C, inhibin, Mullerian inhibiting hormone (MIH), bone morphogenetic proteins BMP2, BMP3, BMP4, BMP5, BMP6, BMP7, BMP8a, BMP8b, BMP10, BMP15, growth differentiating factors GDF1, GDF2, GDF3, GDF5, GDF6, GDF7, Myostatin/GDF8, GDF9, GDF10, GDF11, GDF15, nerve growth factor (NGF), brain-derived neurotrophic factor (BDNF), neurotrophin-3 (NT-3), and neurotrophin-4 (NT-4), artemin, persephin, neurturin, GDNF, agrin, ephrin ligands EFNA1, EFNA2, EFNA3, EFNA4, EFNA5 EFNB1, EFNB2, EFNB3, adiponectin, α2-macroglobulin, agrecan, agouti-related protein (AgRP), α-melanocyte stimulating hormone, albumin, ameloblastin, plasminogen, angiostatin, apolipoproteins A1, AII, B, B100, E, amyloid, autophagin, TGF-beta induced protein Ig H3), biglycan, leukocyte cell-derived chemotaxin LECT2, C-reactive protein, complement components, chordin, chordin-like proteins, collectins, clusterin-like protein 1, cortisol, van willebrandt factor, cytostatins, endostatin, endoreppellin, ephrin ligands, fetuins, ficolins, glucagon, granulysin, gremlin, HGF activator inhibitors HAI-1 and 2, kallilcreins, laminins, leptins, lipocalins, mannan binding lectins (MBL), meteorin, MFG-E8, macrophage galactose N-acetyl-galactosamine-specific lectin (MGL), midkine, myocilin, nestin, osteoblast-specific factor 2, osteopontin, osteocrin, osteoadherin, pentraxin, persephin, placenta growth factor, relaxins, resistin and resistin-like molecules, stem cell factor, stanniocalcins, VE-statin, substance P, tenascins, vitronectin, tissue factor, tissue factor pathway inhibitors, as well as any other of the >7000 proteins identified in the human secretome as listed in the secreted protein database (Chen Y et al., 2005. *Nucleic Acids Res* 33 Database Issue: D169-173), or any mimetic or analog thereof.

Additionally, the UOD of the invention can be used to trimerize enzymes such as for example angiotensin converting enzymes (ACE), matrix metalloproteases, ADAM metalloproteases with thrombospondin type I motif (AD-AMTS1, 4, 5, 13), aminopeptidases, beta-site APP-cleaving enzymes (BACE-1 and -2), chymase, kallilkreins, reelin, serpins, or any mimetic or analog thereof.

Also, the UOD of the invention can be used to trimerize chemotherapeutic agents, and toxins such as small molecule toxins or enzymatically active toxins of bacterial, fungal, plant or animal origin, or fragments thereof to increase potency of targeted compounds for therapeutic purposes, such as for example calicheamicin, *pseudomonas* exotoxin, diphtheria toxin, ricin, saporin, apoptosis-inducing peptides or any analog thereof.

In other embodiments, the UOD of the invention can also be used to fuse antigens for cancer vaccines such as for example the colorectal cancer antigen A33, α-fetoprotein, mucin 1 (MUC1), CDCP1, carcinoembryonic antigen cell adhesion molecules, Her-2, 3 and 4, mesothelin, CDCP1, NETO-1, NETO-2, syndecans, LewisY, CA-125, melanoma associated antigen (MAGE), tyrosinase, epithelial tumor antigen (ETA), among others, as well as for fusing viral envelope antigens or fungal antigens for treatment of infectious diseases.

2.5 Methods of Preparing Chimeric Polypeptide Constructs

The chimeric polypeptides of the present invention may be prepared by chemical synthesis or recombinant means. Usually, the chimeric polypeptides are prepared by expression of a recombinant construct that encodes the chimeric polypeptide in suitable host cells, although any suitable methods can be used. Suitable host cells include, for example, insect cells (e.g., *Aedes aegypti, Autographa californica, Bombyx mori, Drosophila melanogaster, Spodoptera frugiperda,* and *Trichoplusia ni*), mammalian cells (e.g., human, non-human primate, horse, cow, sheep, dog, cat, and rodent (e.g., hamster), avian cells (e.g., chicken, duck, and geese), bacteria (e.g., *Escherichia coli, Bacillus subtilis,* and *Streptococcus spp.*), yeast cells (e.g., *Saccharomyces cerevisiae, Candida albicans, Candida maltosa, Hansenula polymorphs, Kluyveromyces fragilis, Kluyveromyces lactis, Pichia guillerimondii, Pichia pastoris, Schizosaccharomyces pombe* and *Yarrowia lipolytica*), *Tetrahymena* cells (e.g., *Tetrahymena thermophile*) or combinations thereof. Many suitable insect cells and mammalian cells are well-known in the art. Suitable insect cells include, for example, Sf9 cells, Sf21 cells, Tn5 cells, Schneider S2 cells, and High Five cells (a clonal isolate derived from the parental *Trichoplusia ni* BTI-TN-5B1-4 cell line (Invitrogen)). Suitable mammalian cells include, for example, Chinese hamster ovary (CHO) cells, human embryonic kidney cells (HEK293 cells, typically transformed by sheared adenovirus type 5 DNA), NIH-3T3 cells, 293-T cells, Vero cells, HeLa cells, PERC.6 cells (ECACC deposit number 96022940), Hep G2 cells, MRC-5 (ATCC CCL-171), WI-38 (ATCC CCL-75), fetal rhesus lung cells (ATCC CL-160), Madin-Darby bovine kidney ("MDBK") cells, Madin-Darby canine kidney ("MDCK") cells (e.g., MDCK (NBL2), ATCC CCL34; or MDCK 33016, DSM ACC 2219), baby hamster kidney (BHK) cells, such as BHK21-F, HKCC cells, and the like. Suitable avian cells include, for example, chicken embryonic stem cells (e.g., avian embryonic stem cell line EBx®), chicken embryonic fibroblasts, chicken embryonic germ cells, duck cells (e.g., AGE1.CR and AGE1.CR.pIX cell lines (ProBioGen) which are described, for example, in Vaccine 27:4975-4982 (2009) and WO2005/042728), EB66 cells, and the like.

Suitable insect cell expression systems, such as Baculovirus systems, are known to those of skill in the art and described in, e.g., Summers and Smith, Texas Agricultural Experiment Station Bulletin No. 1555 (1987). Materials and methods for Baculovirus/insect cell expression systems are commercially available in kit form from, inter alia, Invitrogen, San Diego Calif. Avian cell expression systems are also known to those of skill in the art and described in, e.g., U.S. Pat. Nos. 5,340,740; 5,656,479; 5,830,510; 6,114,168; and 6,500,668; European Patent No. EP 0787180B; European Patent Application No. EP03291813.8; WO 03/043415; and WO 03/076601. Similarly, bacterial and mammalian cell expression systems are also known in the art and described in, e.g., Yeast Genetic Engineering (Barr et al., eds., 1989) Butterworths, London.

Recombinant constructs encoding the chimeric polypeptides of the present invention can be prepared in suitable vectors using conventional methods. A number of suitable vectors for expression of recombinant proteins in insect or mammalian cells are well-known and conventional in the art. Suitable vectors can contain a number of components, including, but not limited to one or more of the following: an origin of replication; a selectable marker gene; one or more expression control elements, such as a transcriptional control element (e.g., a promoter, an enhancer, a terminator), and/or one or more translation signals; and a signal sequence or leader sequence for targeting to the secretory pathway in a selected host cell (e.g., of mammalian origin or from a heterologous mammalian or non-mammalian species). For example, for expression in insect cells a suitable Baculovirus expression vector, such as pFastBac (Invitrogen), can be used to produce recombinant Baculovirus particles. The Baculovirus particles are amplified and used to infect insect cells to express recombinant protein. For expression in mammalian cells, a vector that will drive expression of the construct in the desired mammalian host cell (e.g., Chinese hamster ovary cells) is used.

The chimeric polypeptides can be purified using any suitable method. Suitable methods for purifying desired proteins including precipitation and various types of chromatography, such as hydrophobic interaction, ion exchange, affinity, chelating and size exclusion are well-known in the art. Suitable purification schemes can be created using two or more of these or other suitable methods. If desired, the chimeric polypeptides can include a purification moiety or "tag" that facilitates purification, as described in Section 2.1.2. Such tagged polypeptides can conveniently be purified, for example from conditioned media, by chelating chromatography or affinity chromatography.

The chimeric polypeptides may include additional sequences. For example, for expression purposes, the natural leader peptide of a heterologous polypeptide of interest (e.g., the natural leader peptide of an enveloped virus fusion protein) may be substituted for a different one.

3. Nucleic Acid Constructs for Endogenous Production of Chimeric Polypeptides

The present invention also contemplates nucleic acid constructs for endogenous production of chimeric polypeptides in a host organism, suitably a vertebrate animal, preferably a mammal such as a human). The nucleic acid constructs can be self-replicating extra-chromosomal vectors/replicons (e.g., plasmids) or vectors that integrate into a host genome. In specific embodiments, the nucleic acid constructs are viral vectors. Exemplary viral vectors include retroviral vectors, lentiviral vectors, poxvirus vectors, vaccinia virus vectors, adenovirus vectors, adenovirus-associated virus vectors, herpes virus vectors, flavivirus vectors, and alphavirus vectors. Viral vectors may be live, attenuated, replication conditional or replication deficient, and typically is a non-pathogenic (defective), replication competent viral vector.

By way of example, when the viral vector is a vaccinia virus vector, a polynucleotide encoding a chimeric polypeptide of the invention may be inserted into a non-essential site of a vaccinia viral vector genome. Such non-essential sites are described, for example, in Perkus et al. (1986. *Virology* 152:285); Hruby et al. (1983. *Proc. Natl. Acad. Sci. USA* 80:3411); Weir et al., (1983. *J. Virol.* 46:530). Suitable promoters for use with vaccinia viruses include but are not limited to P7.5 (see, e.g., Cochran et al., 1985. *J. Virol.*

54:30); P11 (see, e.g., Bertholet, et al., 1985. *Proc. Natl. Acad. Sci. USA* 82:2096); and CAE-1 (see, e.g., Patel et al., 1988. *Proc. Natl. Acad. Sci. USA* 85:9431). Highly attenuated strains of vaccinia are more acceptable for use in humans and include Lister, NYVAC, which contains specific genome deletions (see, e.g., Guerra et al., 2006. *J. Virol.* 80:985-998); Tartaglia et al., 1992. *AIDS Research and Human Retroviruses* 8:1445-1447), or MVA (see, e.g., Gheradi et al., 2005. *J. Gen. Virol.* 86:2925-2936); Mayr et al., 1975. *Infection* 3:6-14). See also Hu et al. (2001. *J. Virol.* 75:10300-10308), describing use of a Yaba-Like disease virus as a vector for cancer therapy); U.S. Pat. Nos. 5,698,530 and 6,998,252. See also, e.g., U.S. Pat. No. 5,443,964. See also U.S. Pat. Nos. 7,247,615 and 7,368,116.

In certain embodiments, an adenovirus vector may be used for expressing a chimeric polypeptide of interest. The adenovirus on which a viral transfer vector may be based may be from any origin, any subgroup, any subtype, mixture of subtypes, or any serotype. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22-30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serotype. Adenoviral serotypes 1 through 51 are available from the American Type Culture Collection (ATCC, Manassas, Va.). Non-group C adenoviruses, and even non-human adenoviruses, can be used to prepare replication-deficient adenoviral vectors. Non-group C adenoviral vectors, methods of producing non-group C adenoviral vectors, and methods of using non-group C adenoviral vectors are disclosed in, for example, U.S. Pat. Nos. 5,801,030, 5,837,511, and 5,849,561, and International Patent Applications WO 97/12986 and WO 98/53087. Any adenovirus, even a chimeric adenovirus, can be used as the source of the viral genome for an adenoviral vector. For example, a human adenovirus can be used as the source of the viral genome for a replication-deficient adenoviral vector. Further examples of adenoviral vectors can be found in Molin et al. (1998. *J. Virol.* 72:8358-8361), Narumi et al. (1998. *Am J. Respir. Cell Mol. Biol.* 19:936-941) Mercier et al. (2004. *Proc. Natl. Acad. Sci. USA* 101:6188-6193), U.S. Publication Nos. 20150093831, 20140248305, 20120283318, 20100008889, 20090175897 and 20090088398 and U.S. Pat. Nos. 6,143,290; 6,596,535; 6,855,317; 6,936,257; 7,125,717; 7,378,087; 7,550,296.

The viral vector can also be based on adeno-associated viruses (AAVs). For a description of AAV-based vectors, see, for example, U.S. Pat. Nos. 8,679,837, 8,637,255, 8,409,842, 7,803,622, and 7,790,449, and U.S. Publication Nos. 20150065562, 20140155469, 20140037585, 20130096182, 20120100606, and 20070036757. The AAV vectors may also be self-complementary (sc) AAV vectors, which are described, for example, in U.S. Patent Publications 2007/01110724 and 2004/0029106, and U.S. Pat. Nos. 7,465,583 and 7,186,699.

Herpes simplex virus (HSV)-based viral vectors are also suitable for endogenous production of the chimeric polypeptides of the invention. Many replication-deficient HSV vectors contain a deletion to remove one or more intermediate-early genes to prevent replication. Advantages of the herpes vector are its ability to enter a latent stage that can result in long-term DNA expression, and its large viral DNA genome that can accommodate exogenous DNA up to 25 kb. For a description of HSV-based vectors, see, for example, U.S. Pat. Nos. 5,837,532, 5,846,782, 5,849,572, and 5,804,413, and International Patent Applications WO 91/02788, WO 96/04394, WO 98/15637, and WO 99/06583.

Retroviral vectors may include those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., 1992. *Virol.* 66:2731-2739; Johann et al., 1992. *J. Virol.* 66:1635-1640; Sommerfelt et al., 1990. *Virology* 176:58-59; Wilson et al., 1989. *J. Virol.* 63:2374-2378; Miller et al., 1991. *J. Virol.* 65:2220-2224; Miller et al., 1990. *Mol. Cell Biol.* 10:4239; Kolberg, 1992. *NIH Res.* 4:43; Cornetta et al., 1991. *Hum. Gene Ther.* 2:215).

In specific embodiments, the retroviral vector is a lentiviral vector. As would be understood by the skilled person, a viral vector, such as a lentiviral vector, generally refers to a viral vector particle that comprises the viral vector genome. For example, a lentiviral vector particle may comprise a lentiviral vector genome. With respect to lentiviral vectors, the vector genome can be derived from any of a large number of suitable, available lentiviral genome based vectors, including those identified for human gene therapy applications (see, e.g., Pfeifer et al., 2001. *Annu. Rev. Genomics Hum. Genet.* 2:177-211). Suitable lentiviral vector genomes include those based on Human Immunodeficiency Virus (HIV-1), HIV-2, feline immunodeficiency virus (FIV), equine infectious anemia virus, Simian Immunodeficiency Virus (SIV), and maedi/visna virus. A desirable characteristic of lentiviruses is that they are able to infect both dividing and non-dividing cells, although target cells need not be dividing cells or be stimulated to divide. Generally, the genome and envelope glycoproteins will be based on different viruses, such that the resulting viral vector particle is pseudotyped. Safety features of the viral vector are desirably incorporated. Safety features include self-inactivating LTR and integration deficiency as described in more detail herein. In certain embodiments integration deficiency may be conferred by elements of the vector genome but may also derive from elements of the packaging system (e.g., a non functional integrase protein that may not be part of the vector genome but supplied in trans). Exemplary vectors contain a packaging signal (psi), a Rev-responsive element (RRE), splice donor, splice acceptor, optionally a central poly-purine tract (cPPT), and WPRE element. In certain exemplary embodiments, the viral vector genome comprises sequences from a lentivirus genome, such as the HIV-1 genome or the SIV genome. The viral genome construct may comprise sequences from the 5' and 3' LTRs of a lentivirus, and in particular may comprise the R and U5 sequences from the 5' LTR of a lentivirus and an inactivated or self-inactivating 3' LTR from a lentivirus. The LTR sequences may be LTR sequences from any lentivirus from any species. For example, they may be LTR sequences from HIV, SIV, FIV or BIV. Typically, the LTR sequences are HIV LTR sequences.

The vector genome may comprise an inactivated or self-inactivating 3' LTR (see, e.g., Zufferey et al., 1998*J. Virol.* 72: 9873; Miyoshi et al., 1998. *J. Virol.* 72:8150). A self-inactivating vector generally has a deletion of the enhancer and promoter sequences from the 3' long terminal repeat (LTR), which is copied over into the 5' LTR during vector integration. In one instance, the U3 element of the 3' LTR contains a deletion of its enhancer sequence, the TATA box, Sp1 and NF-kappa B sites. As a result of the self-inactivating 3' LTR, the provirus that is generated following entry and reverse transcription will comprise an inactivated 5' LTR. The rationale is to improve safety by reducing the risk of mobilization of the vector genome and the influence of the LTR on nearby cellular promoters. The self-inactivating 3' LTR may be constructed by any method known in the art.

Optionally, the U3 sequence from the lentiviral 5' LTR may be replaced with a promoter sequence in the viral construct, such as a heterologous promoter sequence. This can increase the titer of virus recovered from the packaging cell line. An enhancer sequence may also be included. Any enhancer/promoter combination that increases expression of the viral RNA genome in the packaging cell line may be used. In one example, the CMV enhancer/promoter sequence is used (see, e.g., U.S. Pat. Nos. 5,385,839 and 5,168,062).

In certain embodiments, the risk of insertional mutagenesis is minimized by constructing the lentiviral vector to be integration defective. A variety of approaches can be pursued to produce a non-integrating vector genome. These approaches entail engineering a mutation(s) into the integrase enzyme component of the pol gene, such that it encodes a protein with an inactive integrase. The vector genome itself can be modified to prevent integration by, for example, mutating or deleting one or both attachment sites, or making the 3' LTR-proximal polypurine tract (PPT) non-functional through deletion or modification. In addition, non-genetic approaches are available; these include pharmacological agents that inhibit one or more functions of integrase. The approaches are not mutually exclusive, that is, more than one of them can be used at a time. For example, both the integrase and attachment sites can be non-functional, or the integrase and PPT site can be non-functional, or the attachment sites and PPT site can be non-functional, or all of them can be non-functional.

Exemplary lentivirus vectors are described for example in U.S. Publication Nos. 20150224209, 20150203870, 20140335607, 20140248306, 20090148936, and 20080254008.

The viral vectors may also be based on an alphavirus. Alphaviruses include Sindbis virus (and Venezuelan equine encephalitis virus (VEEV)), Aura virus, Babanki virus, Barmah Forest virus, Bebaru virus, Cabassou virus, Chikungunya virus, Eastern equine encephalitis virus, Everglades virus, Fort Morgan virus, Getah virus, Highlands J virus, Kyzylagach virus, Mayaro virus, Me Tri virus, Middleburg virus, Mosso das Pedras virus, Mucambo virus, Ndumu virus, O'nyong-nyong virus, Pixuna virus, Rio Negro virus, Ross River virus, Salmon pancreas disease virus, Semliki Forest virus (SFV), Southern elephant seal virus, Tonate virus, Trocara virus, Una virus, Venezuelan equine encephalitis virus, Western equine encephalitis virus, and Whataroa virus. Generally, the genome of such viruses encode nonstructural (e.g., replicon) and structural proteins (e.g., capsid and envelope) that can be translated in the cytoplasm of the host cell. Ross River virus, Sindbis virus, SFV, and VEEV have all been used to develop viral transfer vectors for transgene delivery. Pseudotyped viruses may be formed by combining alphaviral envelope glycoproteins and retroviral capsids. Examples of alphaviral vectors can be found in U.S. Publication Nos. 20150050243, 20090305344, and 20060177819.

Alternatively, the viral vectors can be based on a flavivirus. Flaviviruses include Japanese encephalitis virus, Dengue virus (e.g., Dengue-1, Dengue-2, Dengue-3, Dengue-4), Yellow fever virus, Murray Valley encephalitis virus, St. Louis encephalitis virus, West Nile virus, Kunjin virus, Rocio encephalitis virus, Ilheus virus, Tick-borne encephalitis virus, Central European encephalitis virus, Siberian encephalitis virus, Russian Spring-Summer encephalitis virus, Kyasanur Forest Disease virus, Omsk Hemorrhagic fever virus, Louping ill virus, Powassan virus, Negishi virus, Absettarov virus, Hansalova virus, Apoi virus, and Hypr virus. Examples of flavivirus vectors can be found in U.S. Publication Nos. 20150231226, 20150024003, 20140271708, 20140044684, 20130243812, 20120294889, 20120128713, 20110135686, 20110014229, 20110003884, 20100297167, 20100184832, 20060159704, 20060088937, 20030194801 and 20030044773.

4. Chimeric Polypeptide Complexes

The chimeric polypeptides of the invention can self-assemble under suitable conditions to form chimeric polypeptide complexes. Accordingly, the present invention further encompasses a method of producing a chimeric polypeptide complex, wherein the method comprises: combining chimeric polypeptides of the present invention under conditions (e.g., in aqueous solution) suitable for the formation of a chimeric polypeptide complex, whereby a chimeric polypeptide complex is produced that comprises three chimeric polypeptides and is characterized by a six-helix bundle formed by the coiled coil structures of the respective structure-forming moieties of the chimeric polypeptides. The chimeric polypeptides that are combined may be identical or non-identical to thereby form homotrimers and heterotrimers, respectively.

Generally the chimeric polypeptides self-assemble in a buffered aqueous solution (e.g., pH about 5 to about 9). If required, mild denaturing conditions can be used, such as, by including urea, small amounts of organic solvents or heat to mildly denature the chimeric polypeptides in order to facilitate refolding and self-assembly.

Any suitable preparation of chimeric polypeptides can be used in the method. For example, conditioned cell culture media that contains the desired chimeric polypeptide can be used in the method. However, it is preferable to use purified chimeric polypeptides in the method.

In particular embodiments in which the structure-stabilizing moiety/universal oligomerization domain is used to oligomerize ectodomain polypeptides to form chimeric polypeptide complexes, the ectodomain polypeptide subunits of the complexes are in the pre-fusion conformation. Without wishing to be bound by any particular theory or mode of operation, it is believed that the pre-fusion form of the ectodomain polypeptide trimer is stabilized in the complexes described herein because the heterologous structure-stabilizing moiety induces complex formation and prevents internal moieties or domains of the ectodomain polypeptide (e.g., the HRA and HRB regions of a Class I ectodomain polypeptide, or the central α-helical coiled coil and fusion loop(s) at the C-terminal region of a Class III ectodomain) from interacting. The interaction of such internal moieties or domains leads to refolding into the post fusion form.

5. Screening Methods

The present invention also encompasses methods of screening for agents that bind preferably specifically with a fusion protein of an enveloped virus, and/or complex of the fusion protein. In specific embodiments, a compound library is screened for binding to an enveloped virus fusion ectodomain polypeptide-containing chimeric polypeptide, or complex thereof.

Candidate agents encompass numerous chemical classes including small molecules such as small organic compounds and macromolecules such as peptides, polypeptides and polysaccharides. Candidate agents comprise functional groups necessary for structural interaction with proteins, particularly hydrogen bonding, and typically include at least an amine, carbonyl, hydroxyl or carboxyl group, desirably at least two of the functional chemical groups. The candidate compounds may comprise cyclical carbon or heterocyclic structures or aromatic or polyaromatic structures substituted with one or more of the above functional groups. Candidate agents are also found among biomolecules including, but not limited to: peptides, saccharides, fatty acids, steroids, purines, pyrimidines, derivatives, structural analogues or combinations thereof. The compound library may comprise natural compounds in the form of bacterial, fungal, plant and animal extracts. Alternatively, or in addition, the compound library may include natural or synthetically produced compounds.

Methods for determining whether an agent binds to a target protein and/or the affinity for an agent for a target protein are known in the art. For example, the binding of an agent to a target protein can be detected and/or quantified using a variety of techniques such as, but not limited to, BioLayer Interferometry (BLI), Western blot, dot blot, surface plasmon resonance method (SPR), enzyme-linked immunosorbent assay (ELISA), amplified luminescent proximity homogeneous assays (AlphaScreen® or AlphaLISA® assays; PerkinElmer), or mass spectrometry based methods.

In some embodiments, agents can be assayed using any surface plasmon resonance (SPR)-based assays known in the art for characterizing the kinetic parameters of the interaction of the agent with ectodomain polypeptide-containing chimeric polypeptide, or complex of the invention. Any SPR instrument commercially available including, but not limited to, BIAcore Instruments (Biacore AB; Uppsala, Sweden); 1Asys instruments (Affinity Sensors; Franklin, Mass.); IBIS system (Windsor Scientific Limited; Berks, UK), SPR-CELLIA systems (Nippon Laser and Electronics Lab; Hokkaido, Japan), and SPR Detector Spreeta (Texas Instruments; Dallas, Tex.) can be used in the methods described herein. See, e.g., Mullett et al. (2000) Methods 22: 77-91; Dong et al., (2002) Reviews in Mol Biotech 82: 303-323; Fivash et al., (1998) Curr Opin Biotechnol 9: 97-101; and Rich et al., (2000) Curr Opin Biotechnol 11: 54-61.

In some embodiments, the biomolecular interactions between the agents and ectodomain polypeptide-containing chimeric polypeptide or complex of the invention can be assayed using BLI on an Octet (ForteBio Inc.). BLI is a label-free optical analytical technique that senses binding between a ligand (such as an ectodomain polypeptide-containing chimeric polypeptide or complex of the invention) that is immobilized on a biosensor tip and an analyte (such as a test compound) in solution by measuring the change in the thickness of the protein layer on the biosensor tip in real-time.

In some embodiments, AlphaScreen (PerkinElmer) assays can be used to characterize binding of test agents to the ectodomain polypeptide-containing chimeric polypeptide or complex of the invention. The acronym ALPHA stands for Amplified Luminescent Proximity Homogeneous Assay. AlphaScreen is a bead-based proximity assay that senses binding between molecules (such as a subject chimeric polypeptide, or complex and a test compound) attached to donor and acceptor beads by measuring the signal produced by energy transfer between the donor and acceptor beads. (See e.g., Eglen et al. (2008) Curr Chem Genomics 1:2-10).

In some embodiments, AlphaLISA® assays can be used to characterize binding of test agents to the chimeric polypeptide or complex of the invention. AlphaLISA® is modified from the AlphaScreen® assay described above to include europium-containing acceptor beads and functions as an alternative to traditional ELISA assays. (See, e.g., Eglen et al. (2008) Curr Chem Genomics 1:2-10.)

A variety of immunoassay techniques, including competitive and non-competitive immunoassays, can be used. The term "immunoassay" encompasses techniques including, without limitation, flow cytometry, FACS, enzyme immunoassays (EIA), such as enzyme multiplied immunoassay technique (EMIT), enzyme-linked immunosorbent assay (ELISA), IgM antibody capture ELISA (MAC ELISA) and microparticle enzyme immunoassay (MEIA), furthermore capillary electrophoresis immunoassays (CEIA), radio-immunoassays (RIA), immunoradiometric assays (IRMA), fluorescence polarization immunoassays (FPIA) and chemiluminescence assays (CL). If desired, such immunoassays can be automated. Immunoassays can also be used in conjunction with laser induced fluorescence. Liposome immunoassays, such as flow-injection liposome immunoassays and liposome immunosensors, are also suitable for use in the present invention. In addition, nephelometry assays, in which, for example, the formation of protein/antibody complexes results in increased light scatter that is converted to a peak rate signal as a function of the marker concentration, are suitable for use in the methods of the present invention.

In some embodiments, binding of test agents to the subject chimeric polypeptide, or complex can be assayed using thermodenaturation methods involving differential scanning fluorimetry (DSF) and differential static light scattering (DSLS).

In some embodiments, binding of test agents to the chimeric polypeptide or complex of the invention can be assayed using a mass spectrometry based method such as, but not limited to, an affinity selection coupled to mass spectrometry (AS-MS) platform. This is a label-free method where the protein and test compound are incubated, unbound molecules are washed away and protein-ligand complexes are analyzed by MS for ligand identification following a decomplexation step.

In some embodiments, binding of test agents to the subject chimeric polypeptide or complex can be quantitated using, for example, detectably labeled proteins such as radiolabeled (e.g., $^{32}P$, $^{35}S$, $^{14}C$ or $^{3}H$), fluorescently labeled (e.g., FITC), or enzymatically labeled chimeric polypeptide or complex or test compound, by immunoassay, or by chromatographic detection.

In some embodiments, the present invention contemplates the use of fluorescence polarization assays and fluorescence resonance energy transfer (FRET) assays in measuring, either directly or indirectly, the degree of interaction between a chimeric polypeptide or complex and a test compound.

All of the above embodiments are suitable for development into high-throughput platforms.

Compounds may be further tested in the animal models to identify those compounds having the most potent in vivo effects, e.g., those that bind specifically to a fusion protein of an enveloped virus, or complex of the fusion protein and preferably stimulate or enhance a therapeutically useful effect, e.g., reduced viral load, reduced infection or symptoms associated therewith. These molecules may serve as "lead compounds" for the further development of pharmaceuticals by, for example, subjecting the compounds to sequential modifications, molecular modeling, and other routine procedures employed in rational drug design.

6. Antigen-Binding Molecules

The ectodomain-containing chimeric polypeptides and complexes of the present invention are useful for producing antigen-binding molecules, which are preferably proteins (i.e., "antigen-binding protein") that are immuno-interactive with an envelope virus fusion protein. In specific embodiments, the ectodomain-containing chimeric polypeptides and complexes include at least one pre-fusion epitope that is not present in the post-fusion form of the envelope virus fusion protein, and therefore useful for preparation of antigen-binding molecules that are immuno-interactive with a metastable or pre-fusion form of an enveloped virus fusion protein.

Those of ordinary skill in the art will appreciate the well developed knowledge base on antigen-binding proteins such as set forth, for example, in Abbas et al., Cellular and Molecular Immunology, $6^{th}$ ed., W.B. Saunders Company (2010) or Murphey et al., Janeway's Immunobiology, $8^{th}$ ed., Garland Science (2011), each of which is incorporated herein by reference in its entirety.

In some embodiments, antigen binding proteins that are immuno-interactive with the chimeric polypeptides and complexes of the present invention are antibodies. Antibodies include intact antibodies and antigen binding fragments thereof, as described in the definition section. An antibody may comprise a complete antibody molecule (including polyclonal, monoclonal, chimeric, humanized, or human versions having full length heavy and/or light chains), or comprise an antigen binding fragment thereof. Antibody fragments include $F(ab')_2$, Fab, Fab', Fv, Fc, and Fd fragments, and can be incorporated into single domain antibodies, single-chain antibodies, maxibodies, minibodies, intrabodies, diabodies, triabodies, tetrabodies, v-NAR and bis-scFv (see e.g., Hollinger and Hudson, 2005, Nature Biotechnology, 23, 9, 1126-1136). Also included are antibody polypeptides such as those disclosed in U.S. Pat. No. 6,703,199, including fibronectin polypeptide monobodies. Other antibody polypeptides are disclosed in U.S. Patent Publication 2005/0238646, which are single-chain polypeptides.

Numerous methods of preparing antibodies to antigens of interest are known in the art. For example, monoclonal antibodies to the chimeric polypeptides and complexes of the present invention can be made using conventional hybridoma methods that are often based on the seminal method of Kohler, G. et al. (1975, "Continuous Cultures Of Fused Cells Secreting Antibody Of Predefined Specificity," Nature 256:495-497) or a modification thereof. Typically, monoclonal antibodies are developed in non-human species, such as mice. In general, a mouse or rat is used for immunization but other animals may also be used. The antibodies may be produced by immunizing mice with an immunogenic amount of an immunogen, in this case a chimeric polypeptide or complex of the present invention. The immunogen may be administered multiple times at periodic intervals such as, bi weekly, or weekly, or may be administered in such a way as to maintain viability in the animal.

To monitor the antibody response, a small biological sample (e.g., blood) may be obtained from the animal and tested for antibody titer against the immunogen. The spleen and/or several large lymph nodes can be removed and dissociated into single cells. If desired, the spleen cells may be screened (after removal of non-specifically adherent cells) by applying a cell suspension to a plate or to a well coated with the antigen. B-cells, expressing membrane-bound immunoglobulin specific for the antigen, will bind to the plate, and are not rinsed away with the rest of the suspension. Resulting B-cells, or all dissociated spleen cells, can then be fused with myeloma cells (e.g., X63-Ag8.653 and those from the Salk Institute, Cell Distribution Center, San Diego, Calif.). Polyethylene glycol (PEG) may be used to fuse spleen or lymphocytes with myeloma cells to form a hybridoma. The hybridoma is then cultured in a selective medium (e.g., hypoxanthine, aminopterin, thymidine medium, otherwise known as "HAT medium"). The resulting hybridomas are then plated by limiting dilution, and are assayed for the production of antibodies that bind specifically to the immunogen, using, for example, FACS (fluorescence activated cell sorting) or immunohistochemistry (IHC) screening. The selected monoclonal antibody-secreting hybridomas are then cultured either in vitro (e.g., in tissue culture bottles or hollow fiber reactors), or in vivo (e.g., as ascites in mice).

As another alternative to the cell fusion technique, Epstein-Barr Virus (EBV)-immortalized B cells may be used to produce monoclonal antibodies that are immuno-interactive with a subject chimeric polypeptide or complex. The hybridomas are expanded and subcloned, if desired, and supernatants are assayed for anti-immunogen activity by conventional assay procedures (e.g., FACS, IHC, radioimmunoassay, enzyme immunoassay, fluorescence immunoassay, etc.).

Thus, the present invention further contemplates methods of producing an antigen-binding molecule that is immuno-interactive with a fusion protein of an enveloped virus, or complex of the fusion protein, wherein the method comprises: (1) immunizing an animal with a chimeric polypeptide complex or composition, as broadly described above and elsewhere herein, wherein an ectodomain polypeptide of the chimeric polypeptide complex corresponds to the fusion protein of the enveloped virus; (2) isolating a B cell from the animal, which is immuno-interactive with the fusion protein or complex thereof; and (3) producing the antigen-binding molecule expressed by that B cell. The present invention also encompasses antigen-binding molecule that are produced by such methods as well as derivatives thereof. Also encompassed are cells including hybridomas that are capable of producing the antigen-binding molecules of the invention, and methods of producing antigen-binding molecules from those cells. In specific embodiments, the antigen-binding molecules produced by the methods and cells of the invention are preferably neutralizing antigen-binding molecules.

Also contemplated are chimeric antibodies and humanized antibodies. In some embodiments, a humanized monoclonal antibody comprises the variable domain of a murine antibody (or all or part of the antigen binding site thereof) and a constant domain derived from a human antibody. Alternatively, a humanized antibody fragment may comprise the antigen binding site of a murine monoclonal antibody and a variable domain fragment (lacking the antigen-binding site) derived from a human antibody. Procedures for the production of engineered monoclonal antibodies include those described in Riechmann et al., 1988, *Nature* 332:323, Liu et al., 1987, *Proc. Nat. Acad. Sci. USA* 84:3439, Larrick et al., 1989, *Bio/Technology* 7:934, and Winter et al., 1993, *TIPS* 14:139. In one embodiment, the chimeric antibody is a CDR grafted antibody. Techniques for humanizing antibodies are discussed in, e.g., U.S. Pat. Nos. 5,869,619; 5,225,539; 5,821,337; 5,859,205; 6,881,557, Padlan et al., 1995, *FASEB J.* 9:133-39, Tamura et al., 2000, J. Immunol. 164:1432-41, Zhang, W., et al., *Molecular Immunology* 42(12):1445-1451, 2005; Hwang W. et al., *Methods* 36(1):35-42, 2005; Dall'Acqua W F, et al., *Methods* 36(1):43-60, 2005; and Clark, M., *Immunology Today* 21(8):397-402, 2000.

An antibody of the present invention may also be a fully human monoclonal antibody. Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein.

Procedures have been developed for generating human monoclonal antibodies in non-human animals. For example, mice in which one or more endogenous immunoglobulin genes have been inactivated by various means have been prepared. Human immunoglobulin genes have been introduced into the mice to replace the inactivated mouse genes. In this technique, elements of the human heavy and light chain locus are introduced into strains of mice derived from embryonic stem cell lines that contain targeted disruptions of the endogenous heavy chain and light chain loci (see also Bruggemann et al., *Curr. Opin. Biotechnol.* 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue.

Antibodies produced in the animal incorporate human immunoglobulin polypeptide chains encoded by the human genetic material introduced into the animal. In one embodiment, a non-human animal, such as a transgenic mouse, is immunized with a subject chimeric polypeptide or complex immunogen.

Examples of techniques for production and use of transgenic animals for the production of human or partially human antibodies are described in U.S. Pat. Nos. 5,814,318, 5,569,825, and 5,545,806, Davis et al., Production of human antibodies from transgenic mice in Lo, ed. Antibody Engineering: Methods and Protocols, Humana Press, NJ:191-200 (2003), Kellermann et al., 2002, *Curr Opin Biotechnol.* 13:593-97, Russel et al., 2000, *Infect Immun.* 68:1820-26, Gallo et al., 2000, *Eur J. Immun.* 30:534-40, Davis et al., 1999, *Cancer Metastasis Rev.* 18:421-25, Gre en, 1999, *J Immunol Methods* 231:11-23, Jakobovits, 1998, *Advanced Drug Delivery Reviews* 31:33-42, Green et al., 1998, *J Exp Med.* 188:483-95, Jakobovits A, 1998, *Exp. Opin. Invest. Drugs* 7:607-14, Tsuda et al., 1997, *Genomics* 42:413-21, Mendez et al., 1997, *Nat. Genet.* 15:146-56, Jakobovits, 1994, *Curr Biol.* 4:761-63, Arbones et al., 1994, *Immunity* 1:247-60, Green et al., 1994, *Nat. Genet.* 7:13-21, Jakobovits et al., 1993, *Nature* 362:255-58, Jakobovits et al., 1993, *Proc Natl Acad Sci USA* 90:2551-55. Chen, J., M. et al. *Int. Immunol.* 5 (1993): 647-656, Choi et al., 1993, *Nature Genetics* 4: 117-23, Fishwild et al., 1996, *Nature Biotech.* 14: 845-51, Harding et al., 1995, *Annals of the New York Academy of Sciences,* Lonberg et al., 1994, *Nature* 368: 856-59, Lonberg, 1994, Transgenic Approaches to Human Monoclonal Antibodies in *Handbook of Experimental Pharmacology* 113: 49-101, Lonberg et al., 1995, *Int. Rev. Immunol.* 13: 65-93, Neuberger, 1996, *Nature Biotech.* 14: 826, Taylor et al., 1992, *Nucleic Acids Research* 20: 6287-95, Taylor et al., 1994, *Int. Immunol.* 6: 579-91, Tomizuka et al., 1997, *Nature Genetics* 16: 133-43, Tomizuka et al., 2000, *Proc Natl Acad Sci USA* 97: 722-27, Tuaillon et al., 1993, *Proc Natl Acad Sci USA* 90: 3720-24, and Tuaillon et al., 1994, *J. Immunol.* 152: 2912-20.; Lonberg et al., *Nature* 368:856, 1994; Taylor et al., *Int. Immunol.* 6:579, 1994; U.S. Pat. No. 5,877,397; Bruggemann et al., 1997 *Curr. Opin. Biotechnol.* 8:455-58; Jakobovits et al., 1995. *Ann. N.Y. Acad. Sci.* 764:525-35. In addition, protocols involving the transgenic mice to produce fully humanized antibodies (XenoMouse®; Abgenix, now Amgen, Inc.) are described, for example in U.S. Ser. No. 05/011,8643 and WO 05/694879, WO 98/24838, WO 00/76310, and U.S. Pat. No. 7,064,244.

The present invention further encompasses fragments of an anti-chimeric polypeptide/complex antibody of the invention. Such fragments can consist entirely of antibody-derived sequences or can comprise additional sequences. Examples of antigen-binding fragments include Fab, F(ab')$_2$, single chain antibodies, diabodies, triabodies, tetrabodies, and domain antibodies. Other examples are provided in Lunde et al., 2002, *Biochem. Soc. Trans.* 30:500-06.

Single chain antibodies may be formed by linking heavy and light chain variable domain (Fv region) fragments via an amino acid bridge (short peptide linker), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, *Prot. Eng.* 10:423; Kortt et al., 2001, *Biomol. Eng.* 18:95-108). By combining different $V_L$ and $V_H$-comprising polypeptides, one can form multimeric scFvs that bind to different epitopes (Kriangkum et al., 2001, *Biomol. Eng.* 18:31-40). Techniques developed for the production of single chain antibodies include those described in U.S. Pat. No. 4,946,778; Bird, 1988, *Science* 242:423; Huston et al., 1988, *Proc. Natl. Acad. Sci. USA* 85:5879; Ward et al., 1989, *Nature* 334:544, de Graaf et al., 2002, *Methods Mol. Biol.* 178:379-87.

Antigen binding fragments derived from an antibody can also be obtained, for example, by proteolytic hydrolysis of the antibody, for example, pepsin or papain digestion of whole antibodies according to conventional methods. By way of example, antibody fragments can be produced by enzymatic cleavage of antibodies with pepsin to provide a 5S fragment termed F(ab')$_2$. This fragment can be further cleaved using a thiol reducing agent to produce 3.5S Fab' monovalent fragments. Optionally, the cleavage reaction can be performed using a blocking group for the sulfhydryl groups that result from cleavage of disulfide linkages. As an alternative, an enzymatic cleavage using papain produces two monovalent Fab fragments and an Fc fragment directly. These methods are described, for example, by Goldenberg, U.S. Pat. No. 4,331,647, Nisonoff et al., *Arch. Biochem. Biophys.* 89:230, 1960; Porter, *Biochem. J.* 73:119, 1959; Edelman et al., in Methods in Enzymology 1:422 (Academic Press 1967); and by Andrews, S. M. and Titus, J. A. in Current Protocols in Immunology (Coligan J. E., et al., eds), John Wiley & Sons, New York (2003), pages 2.8.1-2.8.10 and 2.10A.1-2.10A.5. Other methods for cleaving antibodies, such as separating heavy chains to form monovalent light-heavy chain fragments (Fd), further cleaving of fragments, or other enzymatic, chemical, or genetic techniques may also be used, so long as the fragments bind to the antigen that is recognized by the intact antibody.

Another form of an antibody fragment is a peptide comprising one or more complementarity determining regions (CDRs) of an antibody. CDRs can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., Methods: A Companion to Methods in Enzymology 2:106, 1991; Courtenay-Luck, "Genetic Manipulation of Monoclonal Antibodies," in Monoclonal Antibodies: Production, Engineering and Clinical Application, Ritter et al., (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley-Liss, Inc. 1995)). The antibody fragment further may comprise at least one variable region domain of an antibody described herein. Thus, for example, the V region domain may be monomeric and be a $V_L$ and $V_H$ domain, which is capable of independently binding a subject ectodomain polypeptide or complex with an affinity at least equal to $10^{-7}$ M or less.

The variable region domain may be any naturally occurring variable domain or an engineered version thereof. By engineered version is meant a variable region domain that has been created using recombinant DNA engineering techniques. Such engineered versions include those created, for example, from a specific antibody variable region by insertions, deletions, or changes in or to the amino acid sequences of the specific antibody. Particular examples include engineered variable region domains containing at least one CDR and optionally one or more framework amino acids from a first antibody and the remainder of the variable region domain from a second antibody.

The variable region domain may be covalently attached at a C-terminal amino acid to at least one other antibody domain or a fragment thereof. Thus, for example, a $V_H$ domain that is present in the variable region domain may be linked to an immunoglobulin CH1 domain, or a fragment thereof. Similarly a $V_L$ domain may be linked to a $C_K$ domain or a fragment thereof. In this way, for example, the antibody may be a Fab fragment wherein the antigen binding domain contains associated $V_H$ and $V_L$ domains covalently linked at their C-termini to a CH1 and $C_K$ domain, respectively. The CH1 domain may be extended with further amino acids, for example to provide a hinge region or a portion of a hinge region domain as found in a Fab' fragment, or to provide further domains, such as antibody CH2 and CH3 domains.

7. Compositions

The present invention further provides compositions, including pharmaceutical compositions, comprising a chimeric polypeptide or complex, or a nucleic acid construct from which the chimeric polypeptide or complex is expressible, as broadly described above and elsewhere herein. Representative compositions may include a buffer, which is selected according to the desired use of the chimeric polypeptide or complex, and may also include other substances appropriate to the intended use. Where the intended use is to induce an immune response, the composition is referred to as an "immunogenic" or "immunomodulating" composition. Such compositions include preventative compositions (i.e., compositions administered for the purpose of preventing a condition such as an infection) and therapeutic compositions (i.e., compositions administered for the purpose of treating conditions such as an infection). An immunomodulating composition of the present invention may therefore be administered to a recipient for prophylactic, ameliorative, palliative, or therapeutic purposes.

Those skilled in the art can readily select an appropriate buffer, a wide variety of which are known in the art, suitable for an intended use. In some instances, the composition can comprise a pharmaceutically acceptable excipient, a variety of which are known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds 7.sup.th ed., Lippincott, Williams, & Wilkins; and Handbook of Pharmaceutical Excipients (2000) A. H. Kibbe et al., eds., 3.sup.rd ed. Amer. Pharmaceutical Assoc.

In some embodiments, the compositions comprise more than one (i.e., different) chimeric polypeptide or complex of the invention (e.g., chimeric polypeptides the respective ectodomain polypeptides of which correspond to different enveloped virus fusion proteins), or one or more nucleic acid constructs from which the chimeric polypeptide(s) or complex(es) is/are expressible.

Pharmaceutical compositions of the present invention may be in a form suitable for administration by injection, in a formulation suitable for oral ingestion (such as, for example, capsules, tablets, caplets, elixirs), in the form of an ointment, cream or lotion suitable for topical administration, in a form suitable for delivery as an eye drop, in an aerosol form suitable for administration by inhalation, such as by intranasal inhalation or oral inhalation, or in a form suitable for parenteral administration, that is, subcutaneous, intramuscular or intravenous injection.

Supplementary active ingredients such as adjuvants or biological response modifiers can also be incorporated into pharmaceutical compositions of the present invention. Although adjuvant(s) may be included in pharmaceutical compositions of the present invention they need not necessarily comprise an adjuvant. In such cases, reactogenicity problems arising from the use of adjuvants may be avoided.

In general, adjuvant activity in the context of a pharmaceutical composition of the present invention includes, but is not limited to, an ability to enhance the immune response (quantitatively or qualitatively) induced by immunogenic components in the composition (e.g., a chimeric polypeptide or complex of the present invention). This may reduce the dose or level of the immunogenic components required to produce an immune response and/or reduce the number or the frequency of immunizations required to produce the desired immune response.

Any suitable adjuvant may be included in a pharmaceutical composition of the present invention. For example, an aluminum-based adjuvant may be utilized. Suitable aluminum-based adjuvants include, but are not limited to, aluminum hydroxide, aluminum phosphate and combinations thereof. Other specific examples of aluminum-based adjuvants that may be utilized are described in European Patent No. 1216053 and U.S. Pat. No. 6,372,223. Other suitable adjuvants include Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A; oil in water emulsions including those described in European Patent No. 0399843, U.S. Pat. No.

7,029,678 and PCT Publication No. WO 2007/006939; and/or additional cytokines, such as GM-CSF or interleukin-2, -7, or -12, granulocyte-macrophage colony-stimulating factor (GM-CSF), tumor necrosis factor (TNF) monophosphoryl lipid A (MPL), cholera toxin (CT) or its constituent subunit, heat labile enterotoxin (LT) or its constituent subunit, toll-like receptor ligand adjuvants such as lipopolysaccharide (LPS) and derivatives thereof (e.g., monophosphoryl lipid A and 3-Deacylated monophosphoryl lipid A), *Flavivirus* NS1 and muramyl dipeptide (MDP).

Pharmaceutical compositions of the present invention may be provided in a kit. The kit may comprise additional components to assist in performing the methods of the present invention such as, for example, administration device(s), buffer(s), and/or diluent(s). The kits may include containers for housing the various components and instructions for using the kit components in the methods of the present invention.

8. Dosages and Mutes of Administration

The composition is administered in an "effective amount" that is, an amount effective to achieve an intended purpose in a subject. The dose of active compound(s) administered to a patient should be sufficient to achieve a beneficial response in the subject over time such as a reduction in at least one symptom associated with an infections. The quantity or dose frequency of the pharmaceutically active compounds(s) to be administered may depend on the subject to be treated inclusive of the age, sex, weight and general health condition thereof. In this regard, precise amounts of the active compound(s) for administration will depend on the judgment of the practitioner. One skilled in the art would be able, by routine experimentation, to determine an effective, non-toxic amount of a chimeric polypeptide or complex described herein to include in a pharmaceutical composition of the present invention for the desired therapeutic outcome.

In general, a pharmaceutical composition of the present invention can be administered in a manner compatible with the route of administration and physical characteristics of the recipient (including health status) and in such a way that it elicits the desired effect(s) (i.e. therapeutically effective, immunogenic and/or protective). For example, the appropriate dosage of a pharmaceutical composition of the present invention may depend on a variety of factors including, but not limited to, a subject's physical characteristics (e.g., age, weight, sex), whether the compound is being used as single agent or adjuvant therapy, the type of MHC restriction of the patient, the progression (i.e., pathological state) of a virus infection, and other factors that may be recognized by one skilled in the art. Various general considerations that may be considered when determining an appropriate dosage of a pharmaceutical composition of the present invention are described, for example, in Gennaro (2000) "Remington: The Science and Practice of Pharmacy", 20th edition, Lippincott, Williams, & Wilkins; and Gilman et al., (Eds), (1990), "Goodman And Gilman's: The Pharmacological Bases of Therapeutics", Pergamon Press.

In some embodiments, an "effective amount" of a subject chimeric polypeptide or complex, or a nucleic acid construct from which the chimeric polypeptide or complex is expressible, is an amount sufficient to achieve a desired prophylactic or therapeutic effect, e.g., to reduce a symptom associated with infection, and/or to reduce the number of infectious agents in the individual. In these embodiments, an effective amount reduces a symptom associated with infection and/or reduces the number of infectious agents in an individual by at least about 10%, at least about 20%, at least about 30%, at least about 40%, at least about 50%, at least about 60%, at least about 70%, at least about 80%, or at least about 90%, or more, when compared to the symptom or number of infectious agents in an individual not treated with the chimeric polypeptide or complex. Symptoms of infection by a pathogenic organism, as well as methods for measuring such symptoms, are known in the art. Methods for measuring the number of pathogenic organisms in an individual are standard in the art.

In some embodiments, an "effective amount" of a subject chimeric polypeptide or complex, or a nucleic acid construct from which the chimeric polypeptide or complex is expressible, is an amount that is effective in a selected route of administration to elicit an immune response to an enveloped virus fusion protein.

In some embodiments, e.g., where the chimeric polypeptide comprises a heterologous antigen, an "effective amount" is an amount that is effective to facilitate elicitation of an immune response against that antigen. For example, where the heterologous antigen is an antigen from a different pathogenic organism than the one from which the ectodomain polypeptide is derived), an "effective amount" of a subject chimeric polypeptide or complex, or a nucleic acid construct from which the chimeric polypeptide or complex is expressible, is an amount that is effective for elicitation of an immune response against that antigen and preferably protection of the host against infection, or symptoms associated with infection, by that pathogenic organism. In these embodiments, an effective amount reduces a symptom associated with infection by the pathogenic organism and/or reduces the number of infectious agents corresponding to the pathogenic organism in an individual by at least about 10%, at least about 20%, at least about 30%, at least about 40%, at least about 50%, at least about 60%, at least about 70%, at least about 80%, or at least about 90%, or more, when compared to the symptom or number of infectious agents in an individual not treated with the chimeric polypeptide or complex. Symptoms of infection by a pathogenic organism, as well as methods for measuring such symptoms, are known in the art.

Alternatively, where a heterologous antigen is a cancer- or tumor-associated antigen, an "effective amount" of a chimeric polypeptide or complex, or a nucleic acid construct from which the chimeric polypeptide or complex is expressible, is an amount that is effective in a route of administration to elicit an immune response effective to reduce or inhibit cancer or tumor cell growth, to reduce cancer or tumor cell mass or cancer or tumor cell numbers, or to reduce the likelihood that a cancer or tumor will form. In these embodiments, an effective amount reduces tumor growth and/or the number of tumor cells in an individual by at least about 10%, at least about 20%, at least about 30%, at least about 40%, at least about 50%, at least about 60%, at least about 70%, at least about 80%, or at least about 90%, or more, when compared to the tumor growth and/or number of tumor cells in an individual not treated with the chimeric polypeptide or complex. Methods of measuring tumor growth and numbers of tumor cells are known in the art.

The amount of chimeric polypeptide or complex in each dose is selected as an amount that induces an immune response to the encoded ectodomain polypeptide, and/or that induces an immunoprotective or other immunotherapeutic response without significant, adverse side effects generally associated with typical vaccines. Such amount will vary depending upon which specific ectodomain polypeptide is employed, whether or not the vaccine formulation comprises an adjuvant, and a variety of host-dependent factors.

A pharmaceutical composition of the present invention can be administered to a recipient by standard routes, including, but not limited to, parenteral (e.g., intravenous).

A pharmaceutical composition of the present invention may be administered to a recipient in isolation or in conjunction with additional therapeutic agent(s). In embodiments where a pharmaceutical composition is concurrently administered with therapeutic agent(s), the administration may be simultaneous or sequential (i.e., pharmaceutical composition administration followed by administration of the agent(s) or vice versa).

Typically, in treatment applications, the treatment may be for the duration of the disease state or condition. Further, it will be apparent to one of ordinary skill in the art that the optimal quantity and spacing of individual dosages will be determined by the nature and extent of the disease state or condition being treated, the form, route and site of administration, and the nature of the particular individual being treated. Optimum conditions can be determined using conventional techniques.

In many instances (e.g., preventative applications), it may be desirable to have several or multiple administrations of a pharmaceutical composition of the present invention. For example, a pharmaceutical composition may be administered 1, 2, 3, 4, 5, 6, 7, 8, 9, 10, or more times. The administrations may be from about one to about twelve week intervals, and in certain embodiments from about one to about four week intervals. Periodic re-administration may be desirable in the case of recurrent exposure to a particular pathogen or other disease-associated component targeted by a pharmaceutical composition of the present invention.

It will also be apparent to one of ordinary skill in the art that the optimal course of administration can be ascertained using conventional course of treatment determination tests.

Where two or more entities are administered to a subject "in conjunction" or "concurrently" they may be administered in a single composition at the same time, or in separate compositions at the same time, or in separate compositions separated in time.

Certain embodiments of the present invention involve the administration of pharmaceutical compositions in multiple separate doses. Accordingly, the methods for the prevention (i.e. vaccination) and treatment of infection described herein encompass the administration of multiple separated doses to a subject, for example, over a defined period of time. Accordingly, the methods for the prevention (i.e., vaccination) and treatment of infection disclosed herein include administering a priming dose of a pharmaceutical composition of the present invention. The priming dose may be followed by a booster dose. The booster may be for the purpose of re-vaccination. In various embodiments, the pharmaceutical composition or vaccine is administered at least once, twice, three times or more.

Methods for measuring the immune response are known to persons of ordinary skill in the art. Exemplary methods include solid-phase heterogeneous assays (e.g., enzyme-linked immunosorbent assay), solution phase assays (e.g., electrochemiluminescence assay), amplified luminescent proximity homogeneous assays, flow cytometry, intracellular cytokine staining, functional T-cell assays, functional B-cell assays, functional monocyte-macrophage assays, dendritic and reticular endothelial cell assays, measurement of NK cell responses, IFN-γ production by immune cells, quantification of virus RNA/DNA in tissues or biological fluids (e.g., quantification of viral RNA or DNA in serum or other fluid or tissue/organ), oxidative burst assays, cytotoxic-specific cell lysis assays, pentamer binding assays, and phagocytosis and apoptosis evaluation.

It will be appreciated by persons skilled in the art that numerous variations and/or modifications may be made to the invention as shown in the specific embodiments without departing from the spirit or scope of the present invention as broadly described. The present embodiments are, therefore, to be considered in all respects as illustrative and not restrictive.

In order that the invention may be readily understood and put into practical effect, particular preferred embodiments will now be described by way of the following non-limiting examples.

EXAMPLES

Example 1

RSV F

As an illustration of the ability of the present invention to produce chimeric polypeptides that comprise an ectodomain of a viral fusion protein constrained in a pre-fusion conformation, representative evidence is provided for Respiratory Syncytial virus Fusion protein.

Materials and Methods

Chimeric Polypeptide Design

The ectodomain of RSV F as well as a RSV-F ectodomain mutant (RSV F ds cav) comprising mutations at 4 sites (S155C, S290C, S190F and V207L), as per McLellan et al., (Science, 2013. 342(6158):592-8), were each operably connected to a downstream heterologous structure stabilizing moiety (SSM) that comprises a pair of complementary heptad repeat regions derived from HIV-1 GP160. A control ectodomain construct lacking this SSM and a positive control construct comprising the RSV F ds cav operably connected to the foldon SSM (RSV F ds cav foldon) were also produced. The amino acid sequences of the relevant proteins are presented below.

```
Ectodomain of RSV F (1-520):
                                    [SEQ ID NO: 146]
MELLILKANAITTILTAVTFCFASGQNITEEFYQSTCSAVSKGYLSAL

RTGWYTSVITIELSNIKKNKCNGTDAKVKLIKQELDKYKNAVTELQLL

MQSTQATNNRARRELPRFMNYTLNNAKKTNVTLSKKRKRRFLGFLLGV

GSAIASGVAVSKVLHLEGEVNKIKSALLSTNKAVVSLSNGVSVLTSKV

LDLKNYIDKQLLPIVNKQSCSISNIETVIEFQQKNNRLLEITREFSVN

AGVTTPVSTYMLTNSELLSLINDMPITNDQKKLMSNNVQIVRQQSYSI

MSIIKEEVLAYVVQLPLYGVIDTPCWKLHTSPLCTTNTKEGSNICLTR

TDRGWYCDNAGSVSFFPQAETCKVQSNRVFCDTMNSLTLPSEVNLCNV

DIFNPKYDCEIMTSKTDVSSSVITSLGAIVSCYGKTKCTASNKNRGII

KTFSNGCDYVSNKGVDTVSVGNTLYYVNKQEGKSLYVKGEPIINFYDP

LVFPSDEFDASISQVNEKINQSLAFIRKSDELLHNVNAGK.
```

Ectodomain of RSV F (1-520)-HIV GP160-based SSM:
[SEQ ID NO: 147]
MELLILKANAITTILTAVTFCFASGQNITEEFYQSTCSAVSKGYLSAL

RTGWYTSVITIELSNIKKNKCNGTDAKVKLIKQELDKYKNAVTELQLL

MQSTQATNNRARRELPRFMNYTLNNAKKTNVTLSKKRKRRFLGFLLGV

GSAIASGVAVSKVLHLEGEVNKIKSALLSTNKAVVSLSNGVSVLTSKV

LDLKNYIDKQLLPIVNKQSCSISNIETVIEFQQKNNRLLEITREFSVN

AGVTTPVSTYMLTNSELLSLINDMPITNDQKKLMSNNVQIVRQQSYSI

MSIIKEEVLAYVVQLPLYGVIDTPCWKLHTSPLCTTNTKEGSNICLTR

TDRGWYCDNAGSVSFFPQAETCKVQSNRVFCDTMNSLTLPSEVNLCNV

DIFNPKYDCEIMTSKTDVSSSVITSLGAIVSCYGKTKCTASNKNRGII

KTFSNGCDYVSNKGVDTVSVGNTLYYVNKQEGKSLYVKGEPIINFYDP

LVFPSDEFDASISQVNEKINQSLAFIRKSDELLHNVNAGK*SGIVQQQN*

*NLLRAIEAQQHLLQLTVWGIKQLQARILAGGSGGHTTWMEWDREINNY*

*TSLIHSLIEESQNQPAKDEQELLE.*

Ectodomain of RSV F (1-520)-DScav mutations-HIV
GP160-based SSM:
[SEQ ID NO: 150]
MELLILKANAITTILTAVTFCFASGQNITEEFYQSTCSAVSKGYLSAL

RTGWYTSVITIELSNIKKNKCNGTDAKVKLIKQELDKYKNAVTELQLL

MQSTQATNNRARRELPRFMNYTLNNAKKTNVTLSKKRKRRFLGFLLGV

GSAIASGVAVCKVLHLEGEVNKIKSALLSTNKAVVSLSNGVSVLTFKV

LDLKNYIDKQLLPILNKQSCSISNIETVIEFQQKNNRLLEITREFSVN

AGVTTPVSTYMLTNSELLSLINDMPITNDQKKLMSNNVQIVRQQSYSI

MCIIKEEVLAYVVQLPLYGVIDTPCWKLHTSPLCTTNTKEGSNICLTR

TDRGWYCDNAGSVSFFPQAETCKVQSNRVFCDTMNSLTLPSEVNLCNV

DIFNPKYDCKIMTSKTDVSSSVITSLGAIVSCYGKTKCTASNKNRGII

KTFSNGCDYVSNKGVDTVSVGNTLYYVNKQEGKSLYVKGEPIINFYDP

LVFPSDEFDASISQVNEKINQSLAFIRKSDELLHNVNAGK*SGIVQQQN*

*NLLRAIEAQQHLLQLTVWGIKQLQARILAGGSGGHTTWMEWDREINNY*

*TSLIHSLIEESQNQPAKDEQELLE.*

Ectodomain of RSV F (1-513)-DScav mutations-
Foldon SSM (control as per McLellan et al.,
(Science, 2013. 342(6158):592-8)):
[SEQ ID NO: 151]
MELLILKANAITTILTAVTFCFASGQNITEEFYQSTCSAVSKGYLSAL

RTGWYTSVITIELSNIKKNKCNGTDAKVKLIKQELDKYKNAVTELQLL

MQSTQATNNRARRELPRFMNYTLNNAKKTNVTLSKKRKRRFLGFLLGV

GSAIASGVAVCKVLHLEGEVNKIKSALLSTNKAVVSLSNGVSVLTFKV

LDLKNYIDKQLLPILNKQSCSISNIETVIEFQQKNNRLLEITREFSVN

AGVTTPVSTYMLTNSELLSLINDMPITNDQKKLMSNNVQIVRQQSYSI

MCIIKEEVLAYVVQLPLYGVIDTPCWKLHTSPLCTTNTKEGSNICLTR

TDRGWYCDNAGSVSFFPQAETCKVQSNRVFCDTMNSLTLPSEVNLCNV

DIFNPKYDCKIMTSKTDVSSSVITSLGAIVSCYGKTKCTASNKNRGII

KTFSNGCDYVSNKGVDTVSVGNTLYYVNKQEGKSLYVKGEPIINFYDP

LVFPSDEFDASISQVNEKINQSLAFIRKSDELL*SAIGGYIPEAPRDGQ*

*AWRKDGEWVLLSTFLGGLVPRGSGSAWSHPQFEK*

Protein Expression and Purification

Codon optimized DNA sequences encoding the chimeric fusion proteins RSV F clamp, RSV F ds cav clamp, RSV F ds cav foldon, and a control RSV F ectodomain lacking HIV-1 HRA and HRB sequences were each incorporated into the pIRES-2 eukaryotic expression vector downstream of the CMV promoter. The resulting plasmids were transfected into Chinese hamster ovary (CHO) cells grown in chemically defined CHO (CD-CHO) media (Gibco) containing 600 µg plasmid and 2.4 mg of linear polyethylenimine in 300 mL of CHO cells at a density of $1\times10^6$ cells per mL. After 4 h of incubation with the transfection reagent cells were pelleted and resuspended in 300 mL of CD-CHO containing 8 mM Glutamax (Gibco), 100 units/mL of penicillin (Gibco), 100 µg/mL of streptomycin (Gibco), 7.5% CHO CD Efficient Feed A (Gibco), and 7.5% CHO CD Efficient Feed B (Gibco). Cells were then incubated for 7 days at 37° C., 5% CO2, shaking at ~120 rpm. After 7 days cells were removed by centrifugation for 10 min at 6,000×g and supernatant was filtered.

Recombinant proteins were purified by affinity chromatography with specific monoclonal antibodies covalently coupled to HiTrap NHS-activated HP columns (GE). Chimeric clamp stabilized RSV F was purified by mAb 1281 (Frey, et al., Nat Struct Mol Biol. 2010. 17(12):1486-91) which binds to the 6-helix bundle formed by HIV-1 HRA and HRB. The RSV F ds cav clamp, RSV F ds cav foldon chimeric proteins and control RSV F were purified using mAb 101F (McLellan, et al. *J Virol.* 2010. 84(23):12236-44). Purification of the desired protein was confirmed by SDS-PAGE.

Results

Protein Conformation

Protein conformation was assessed with conformation specific monoclonal antibodies. Incorporation of the SSM based on HIV-1 GP160 HR1 and HR2 sequences downstream of the ectodomain acts as a kind of 'molecular clamp' that inhibits the fusion ectodomain polypeptide from rearranging to a post-fusion conformation. Evidence that such chimeric fusion protein is stabilized in the pre-fusion conformation while the corresponding naked ectodomain (i.e., expressed alone) forms the post fusion form is shown in FIGS. 1A-C.

Example 2

INFA HA

As another illustration of the ability of the present invention to produce chimeric polypeptides that comprise an ectodomain of a viral fusion protein constrained in a pre-fusion conformation, representative evidence is provided for Influenza A (INFA) Hemagglutinin (HA) protein. Furthermore, representative evidence is provided for INFA HA protein that the chimeric protein constrained in the prefusion conformation via the aforementioned method is able to induce an improved neutralizing immune response upon administration to mice.

Materials and Methods

Chimeric Polypeptide Design

The ectodomain of INFA HA was operably connected to a downstream heterologous structure stabilizing moiety that comprises a pair of complementary heptad repeat regions derived from HIV-1 GP160. The amino acid sequences of the resulting chimeric protein and its control are presented below.

Ectodomain of INFA HA (1-529):
[SEQ ID NO: 148]
MKTIIALSYILCLVFAQKLPGNDNSTATLCLGHHAVPNGTIVKTITND

QIEVTNATELVQSSSTGEICDSPHQILDGKNCTLIDALLGDPQCDGFQ

NKKWDLFVERSKAYSNCYPYDVPDYASLRSLVASSGTLEFNNESFNWT

GVTQNGTSSACIRRSKNSFFSRLNWLTHLNFKYPALNVTMPNNEQFDK

LYIWGVHHPGTDKDQIFLYAQASGRITVSTKRSQQTAIPNIGSRPRVR

NIPSRISIYWTIVKPGDILLINSTGNLIAPRGYFKIRSGESSIMRSDA

PIGKCNSECITPNGSIPNDKPFQNVNRITYGACPRYVKQNTLKLATGM

RNVPEKQTRGIFGAIAGFIENGWEGMVDGWYGFRHQNSEGRGQAADLK

STQAAIDQINGKLNRUGKTNEKFHQIEKEFSEVEGRIQDLEKYVEDTK

IDLWSYNAELLVALENQHTIDLTDSEMNKLFEKTKKQLRENAEDMGNG

CFKIYHKCDNACIGSIRNGTYDHDVYRDEALNNRFQIKGVELKSGYKD.

Ectodomain of INFA HA (1-529)-HIV GP160-based SSM:
[SEQ ID NO: 149]
MKTIIALSYILCLVFAQKLPGNDNSTATLCLGHHAVPNGTIVKTITND

QIEVTNATELVQSSSTGEICDSPHQILDGKNCTLIDALLGDPQCDGFQ

NKKWDLFVERSKAYSNCYPYDVPDYASLRSLVASSGTLEFNNESFNWT

GVTQNGTSSACIRRSKNSFFSRLNWLTHLNFKYPALNVTMPNNEQFDK

LYIWGVHHPGTDKDQIFLYAQASGRITVSTKRSQQTAIPNIGSRPRVR

NIPSRISIYWTIVKPGDILLINSTGNLIAPRGYFKIRSGESSIMRSDA

PIGKCNSECITPNGSIPNDKPFQNVNRITYGACPRYVKQNTLKLATGM

RNVPEKQTRGIFGAIAGFIENGWEGMVDGWYGFRHQNSEGRGQAADLK

STQAAIDQINGKLNRUGKTNEKFHQIEKEFSEVEGRIQDLEKYVEDTK

IDLWSYNAELLVALENQHTIDLTDSEMNKLFEKTKKQLRENAEDMGNG

CFKIYHKCDNACIGSIRNGTYDHDVYRDEALNNRFQIKGVELKSGYKD

*GSGIVQQQNNLLRAIEAQQHLLQLTVWGIKQLQARILAGGSGGHTTWM*

*EWDREINNYTSLIHSLIEESQNQPAKDEQELLE.*

Protein Expression and Purification

Codon optimized DNA sequences encoding the chimeric fusion protein Influenza H3 clamp or a control ectodomain lacking HIV-1 HRA and HRB sequences were incorporated into the pIRES-2 eukaryotic expression vector following the CMV promoter. The resulting plasmids were transfected into CHO cells and the transfected cells were grown and collected according to Example 1.

Recombinant proteins were purified by affinity chromatography with specific monoclonal antibodies covalently coupled to HiTrap NHS-activated HP columns (GE). Chimeric clamp stabilized Influenza HA was purified by mAb 1281 (Frey, et al., Nat Struct Mol Biol. 2010. 17(12):1486-91) which binds to the 6-helix bundle formed by HIV-1 HRA and HRB. The ectodomain of Influenza HA was purified with mAb C05 (Ekiert, et al., Nature, 2012. 489 (7417): 526-32). Purification of the desired protein was confirmed by SDS-PAGE. Commercial quadrivalent influenza vaccine (QIV) for the 2015 season (FluQuadri™) was purchased from Sanofi Pasteur.

Results

Protein Conformation

Figure 2:
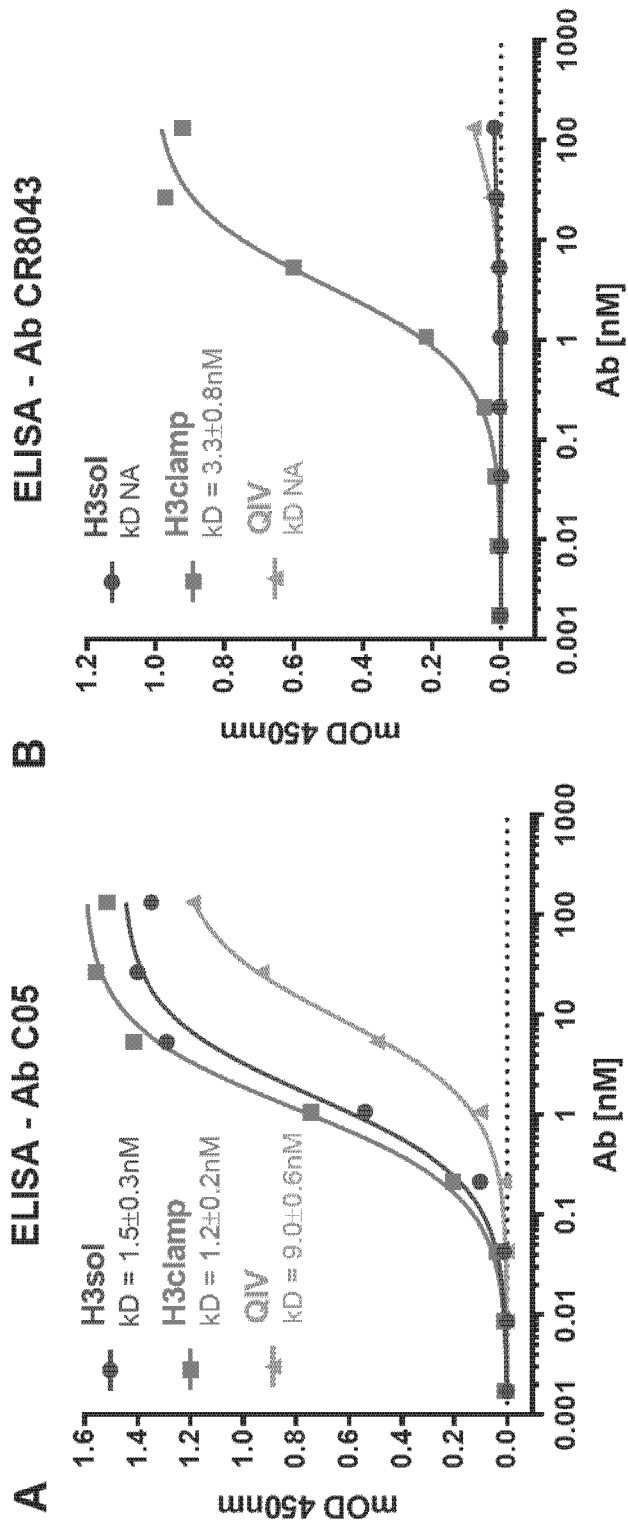
FIG. 2 is a graphical representation showing ELISA Influenza H3 reactivity with conformation specific monoclonal antibody. A. Head specific antibody C05 (Ekiert et al., *Nature* 2012. 489(7417): 526-32) binds similarly to H3sol, H3 clamp and QIV), however the prefusion, stem, specific monoclonal antibody CR8043 (Friesen, et al., *Proc. Natl. Acad. Sci. USA* 2014. 111(1): 445-50) binds to chimeric clamp stabilized Influenza HA with an affinity of 3.3±0.8 nM but does not bind to the corresponding HA ectodomain or commercial QIV.

Protein conformation was assessed with conformation specific monoclonal antibodies and size-exclusion chromatography. Incorporation of the SSM based on HIV-1 GP160 HR1 and HR2 sequences downstream of the respective ectodomains acts as a kind of 'molecular clamp' that inhibits the fusion ectodomain polypeptide from rearranging to a post-fusion conformation. Evidence that such chimeric fusion protein is stabilized in the pre-fusion conformation while the naked ectodomain (i.e., expressed alone) forms the post fusion form is shown in FIGS. 2 and 3.

Animal Immunization

To test the utility of the viral fusion proteins stabilized in their pre-fusion form via the incorporation of the 6-helix bundle forming moiety as immunogens, BALB/c mice were immunized with the chimeric clamp stabilized influenza HA, the corresponding non-stabilized ectodomain or the commercial QIV. Five BALB/c mice per group were immunized with 5 μg of purified protein (or PBS) with 3 μg of saponin adjuvant Quil-A. Immunization was via intradermal delivery and mice were immunized twice, three weeks apart. Three weeks following the second immunization mice were sacrificed and sera collected. Neutralization effect of pooled sera from each group was assessed against Influenza A/Hebei Baoding Anguo/51/2010 (H3N2) in a plaque reduction neutralization test (PRNT). Sera from mice vaccinated chimeric clamp stabilized Influenza HA showed strong neutralizing activity with an IC50 value of 1:14,000 (95% CI 11,000-17,000), while sera from mice vaccinated with the corresponding HA ectodomain showed no neutralizing activity even at the highest dose tested of 1:20 and sera from mice vaccinated with commercial QIV show neutralization with an IC50 value of ~1:180. Therefore, stabilization of the pre-fusion form of the influenza HA via the incorporation of a structure-stabilizing moiety comprised of HIV-1 HR1 and HR2 is critical for a strong neutralizing immune response and is able to increase the neutralizing immune response by approximately 80-fold compared to a current commercial inactivated vaccine.

Figure 5:
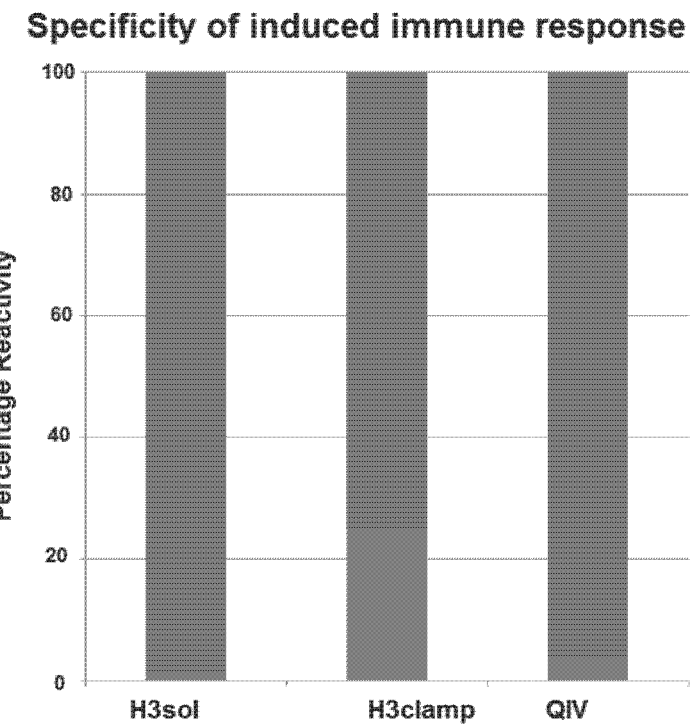
FIG. 5 is a graphical representation showing subdomain specificity of the induced immune response. Sera from mice vaccinated with H3sol, H3clamp or commercial vaccine (QIV) showed differential reactivity with the head and stem subdomains of H3. Sera from mice immunized with chimeric clamp stabilized Influenza HA showed the greatest reactivity to the stem domain (~25% of the total H3 specific response), while sera from mice immunized with H3sol and QIV this percentage was much lower (1% and 4%, respectively).

To confirm that clamp stabilized HA induced a novel population of antibodies that did not interact with post-fusion HA sol or the commercial QIV H3clamp vaccinated mouse sera were pre-incubated with H3sol or QIV to remove any antibodies capable of binding these forms (FIG. 4, white bars). Neither incubation with H3sol or QIV resulted in a decrease in virus neutralization, however pre-incubation with H3clamp resulted in the complete removal of virus neutralization activity. To test if induced immune response was specific for the head or stem subdomain of HA, ELISA reactivity was compared against the whole H3clamp and a H3 stem only domain (as outlined above in Section 2.3.2). Prior to ELISA mouse sera were pre-incubated with EBOV GP clamp (as outlined above in Section 2.3.12) to reabsorb antibodies specific for the clamp domain itself. Sera were then added to an ELISA plate coated with H3clamp or H3stem and humoral antibody reactivity measured via ELISA. Dilution factors producing half maximal absorbance were compared to estimate the percentage of immunity specific for the stem domain. Immunity to the head domain was estimated by subtracting stem domain specific immunity from the total (see, FIG. 5). H3 clamp immunization resulted in approximately 25% of humoral immunity reactive with the stem domain and 75% with the head domain. In contrast, QIV immunization resulted in only 4% of humoral immunity reactive with the stem domain and 96% with the head and H3sol immunization resulted in only 1% of humoral immunity reactive with the stem domain and 99% with the head.

Figure 6:
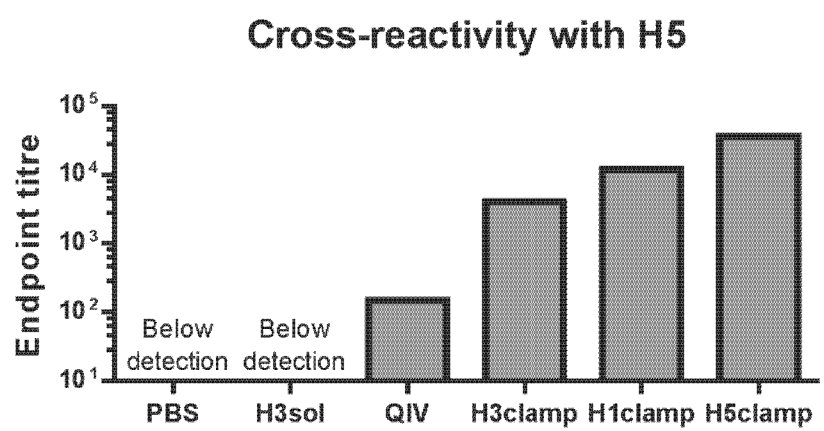
FIG. 6 is a graphical representation showing H5 cross-reactivity. ELISA was used to measure reactivity with H5. Endpoint titers were calculated as the maximum dilution producing greater than background+3 standard deviations reactivity. Sera from mice vaccinated with H3sol, H3clamp, commercial vaccine (QIV), H1 clamp and H5clamp showed differential reactivity with H5. Sera from mice immunized with H3clamp or H1clamp showed much greater cross reactivity with H5 than QIV (27-fold increase and 81-fold increase, respectively).

Reactivity of the immune response with H5 from avian influenza H5N1 was compared using the H5clamp construct (as outlined above in Section 2.3.3). Sera from mice vaccinated with H5clamp or H1clamp was also included in the analysis. Prior to ELISA mouse sera was pre-incubated with EBOV GP clamp (as outlined above in Section 2.3.12) to reabsorb antibodies specific for the clamp domain itself. Sera was then added to an ELISA plate coated with H5clamp and humoral antibody reactivity measured via ELISA. Endpoint tires were calculated and are presented in FIG. 6. H3clamp and H1clamp both showed substantial cross reactivity with H5, which was significantly greater than that of QIV (27-fold increase and 81-fold increase, respectively).

Figure 7:
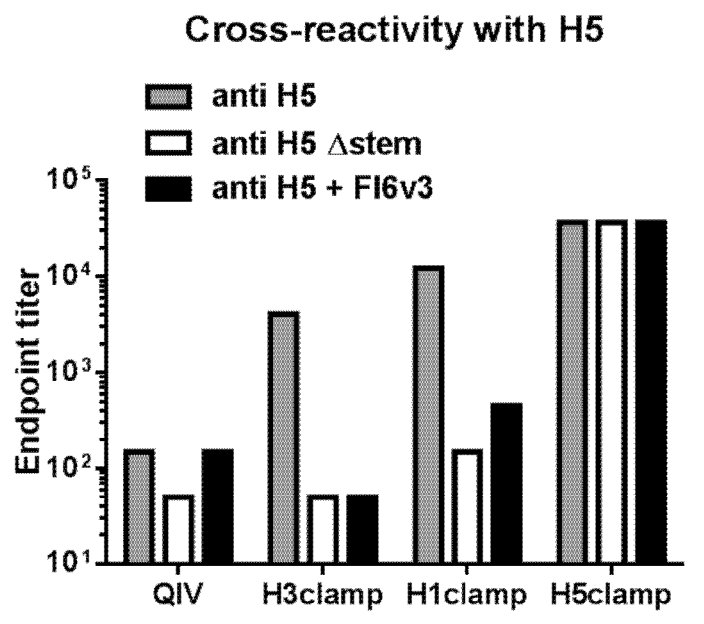

The present inventors next set out to determine the subdomain responsible for H5 cross-reactivity. Prior to measuring ELISA reactivity with H5 ELISA, mouse sera was pre-incubated with EBOV GP clamp (as outlined above in Section 2.3.12) and/or H3stem H3 stem only domain (as outlined above in Section 2.3.2) to pre-absorb antibodies specific for the clamp domain itself and/or the H3 stem domain or human monoclonal antibody FI6v3 (Corti et al., PNAS 2011) was added to outcompete stem specific antibodies. Sera was then added to an ELISA plate coated with H5clamp and endpoint titres were calculated via ELISA (FIG. 7). QIV immunized mice showed low reactivity with H5 that was only minimally affected by stem absorption/Fi6V3 competition. Sera from mice immunized with H5 clamp showed high reactivity that was not affected by stem absorption/Fi6V3 competition indicating a strong head specific immune response. However, sera from mice immunized with H1 clamp or H3 clamp showed strong reactivity with H5 and this was significantly reduced by stem absorption/ Fi6V3 competition indicating a stem specific response is responsible for H5 cross-reactivity.

Example 3

MERS Spike

As yet another illustration of the ability of the present invention to produce chimeric polypeptides that comprise an ectodomain of a viral fusion protein constrained in a prefusion conformation, representative evidence is provided for Middle East Respiratory Syndrome (MERS) virus Spike protein.

Materials and Methods

Chimeric Polypeptide Design

The ectodomain of MERS Spike protein was operably connected to a downstream heterologous structure stabilizing moiety that comprises a pair of complementary heptad repeat regions derived from HIV-1 GP160. The amino acid sequence of the resulting chimeric protein is presented below.

Ectodomain of MERS Spike (1-1296)-HIV GP160-based SSM:

[SEQ ID NO: 152]
MIHSVFLLMFLLTPTESYVDVGPDSVKSACIEVDIQQTFFDKTWPRPI

DVSKADGIIYPQGRTYSNITITYQGLFPYQGDHGDMYVYSAGHATGTT

PQKLFVANYSQDVKQFANGFVVRIGAAANSTGTVIISPSTSATIRKIY

PAFMLGSSVGNFSDGKMGRFFNHTLVLLPDGCGTLLRAFYCILEPRSG

NHCPAGNSYTSFATYHTPATDCSDGNYNRNASLNSFKEYFNLRNCTFM

YTYNITEDEILEWFGITQTAQGVHLFSSRYVDLYGGNMFQFATLPVYD

TIKYYSIIPHSIRSIQSDRKAWAAFYVYKLQPLTFLLDFSVDGYIRRA

IDCGFNDLSQLHCSYESFDVESGVYSVSSFEAKPSGSVVEQAEGVECD

FSPLLSGTPPQVYNFKRLVFTNCNYNLTKLLSLFSVNDFTCSQISPAA

IASNCYSSLILDYFSYPLSMKSDLGVSSAGPISQFNYKQSFSNPTCLI

LATVPHNLTTITKPLKYSYINKCSRLLSDDRTEVPQLVNANQYSPCVS

IVPSTVWEDGDYYRKQLSPLEGGGWLVASGSTVAMTEQLQMGFGITVQ

YGTDTNSVCPKLEFANDTKIASQLGNCVEYSLYGVSGRGVFQNCTAVG

VRQQRFVYDAYQNLVGYYSDDGNYYCLRACVSVPVSVIYDKETKTHAT

LFGSVACEHISSTMSQYSRSTRSMLKRRDSTYGPLQTPVGCVLGLVNS

SLFVEDCKLPLGQSLCALPDTPSTLTPRSVRSVPGEMRLASIAFNHPI

QVDQFNSSYFKLSIPTNFSFGVTQEYIQTTIQKVTVDCKQYICNGFQK

CEQLLREYGQFCSKINQALHGANLRQDDSVRNLFASVKSSQSSPIIPG

FGGDFNLTLLEPVSISTGSRSARSAIEDLLFDKVTIADPGYMQGYDDC

MQQGPASARDLICAQYVAGYKVLPPLMDVNMEAAYTSSLLGSIAGVGW

TAGLSSFAAIPFAQSIFYRLNGVGITQQVLSENQKLIANKFNQALGAM

QTGFTTTNEAFRKVQDAVNNNAQALSKLASELSNTFGAISASIGDIIQ

RLDVLEQDAQIDRLINGRLTTLNAFVAQQLVRSESAALSAQLAKDKVN

ECVKAQSKRSGFCGQGTHIVSFVVNAPNGLYFMHVGYYPSNHIEVVSA

YGLCDAANPTNCIAPVNGYFIKTNNTRIVDEWSYTGSSFYSPEPITSL

NTKYVAPQVTYQNISTNLPPPLLGNSTGIDFQDELDEFFKNVSTSIPN

FGSLTQINTTLLDLTYEMLSLQQVVKALNESYIDLKELGNYTYYNKWP

*GGSGIVQQQNNLLRAIEAQQHLLQLTVWGIKQLQARILAGGSGGHTTW*

*MEWDREINNYTSLIHSLIEESQNQQEKNEQELLE*.

Protein Expression and Purification

A codon optimized DNA sequence encoding the chimeric fusion protein MERS S clamp was incorporated into the pIRES-2 eukaryotic expression vector following the CMV promoter. The resulting plasmid was transfected into CHO cells and transfected cells were grown and collected according to Example 1. The recombinant protein was purified by affinity chromatography with mAb 1281 (Frey, et al., Nat Struct Mol Biol. 2010. 17(12):1486-91) as described in Example 1.

Results

Protein Conformation

Figure 8:
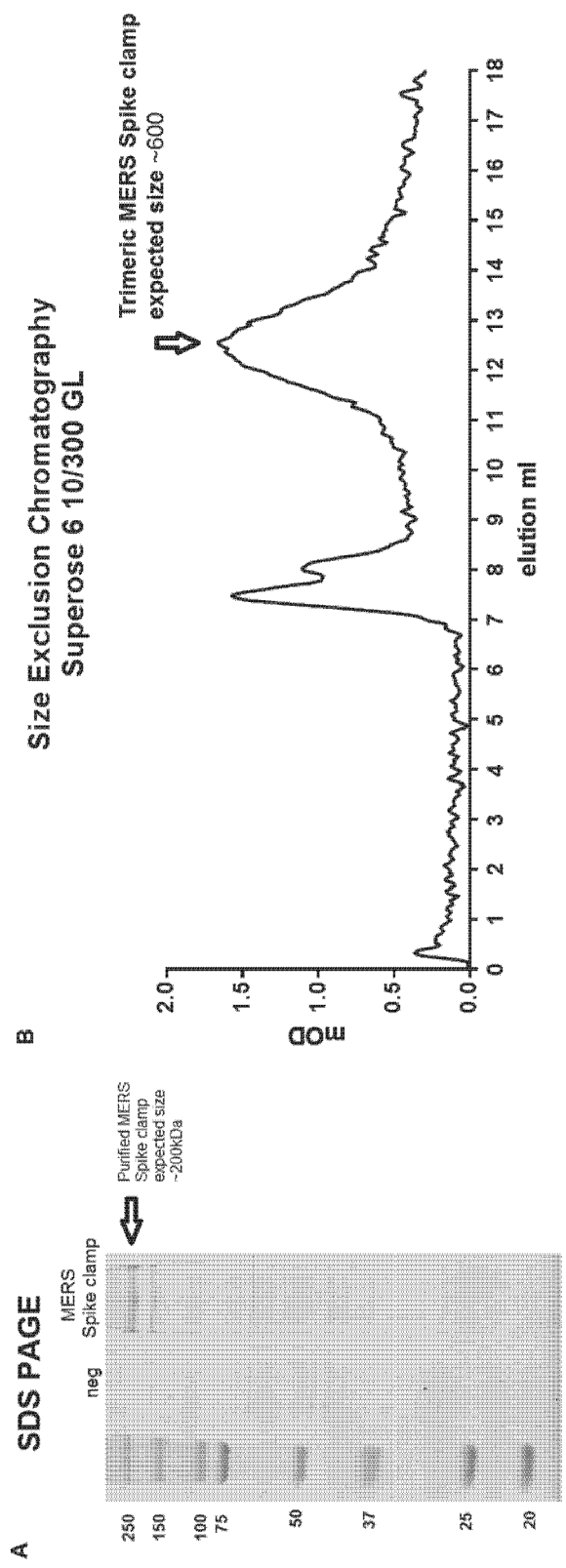
FIG. 8 is a graphical representation showing the purification of a soluble trimeric clamp stabilized MERS Spike protein. A. SDS-PAGE of clamp stabilized MERS Spike purified from CHO supernatant following expression. Protein band at approximately 200 kDA is at the correct approximate size for the resulting monomeric MERS protein including associated glycans and is not visible in a control purification from CHO supernatant. B. Size exclusion chromatography of clamp stabilized MERS Spike protein on a Superdex 6 10/300 GL column. Elution of the major protein at 12.5 ml is indicative of approximately 600 kDA which is the correct size for non-aggregated, trimeric MERS protein including associated glycans.

Protein conformation was assessed using SDS-PAGE and size exclusion chromatography. The results presented in FIG. 8 indicate that the MERS S clamp chimeric fusion protein is stabilized in a pre-fusion conformation.

Example 4

EBOV GP

Still another illustration of the ability of the present invention to produce chimeric polypeptides that comprise an ectodomain of a viral fusion protein constrained in a pre-fusion conformation, representative evidence is provided for EBOV Glycoprotein (GP). Further evidence is provided as illustration of the stability of this chimeric polypeptide at high temperatures for extended periods. Furthermore, representative evidence is provided for EBOV GP that the chimeric protein constrained in the pre-fusion conformation via the aforementioned method is able to induce a neutralizing immune response upon administration to mice.

Materials and Methods

Chimeric Polypeptide Design

An EBOV GP lacking the mucin-like domain was operably connected to a downstream heterologous structure stabilizing moiety that comprises a pair of complementary heptad repeat regions derived from HIV-1 GP160. The amino acid sequence of the resulting chimeric protein is presented below.

```
EBOV GP ectodomain, minus mucin like domain
(1-311, 462-650)-HIV GP160-based SSM
                                  [SEQ ID NO: 139]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVGGNNTHHQDTGEESASSGKLGLITN

TIAGVAGLITGGRRTRREAIVNAQPKCNPNLHYWTTQDEGAAIGLAWI

PYFGPAAEGIYIEGLMHNQDGLICGLRQLANETTQALQLFLRATTELR

TFSILNRKAIDFLLQRWGGTCHILGPDCCIEPHDWTKNITDKIDQIIH

DFVDKTLPDQGDNDNWWTGWRQGGSGIVQQQNNLLRAIEAQQHLLQLT
```

VWGIKQLQARILAGGSGGHTTWMEWDREINNYTSLIHSLIEESQNQQE

KNEQELLE.

Protein Expression and Purification

A codon optimized DNA sequence encoding the EBOV GP delta mucin clamp was incorporated into the pIRES-2 eukaryotic expression vector downstream of the CMV promoter. The resulting plasmid was transfected into CHO cells and transfected cells were grown and collected according to Example 1. The recombinant protein was purified by affinity chromatography using mAb Kz52 (Murin et al., PNAS. 2014 11(48):17182-7).

Results

Protein Conformation

Figure 11:
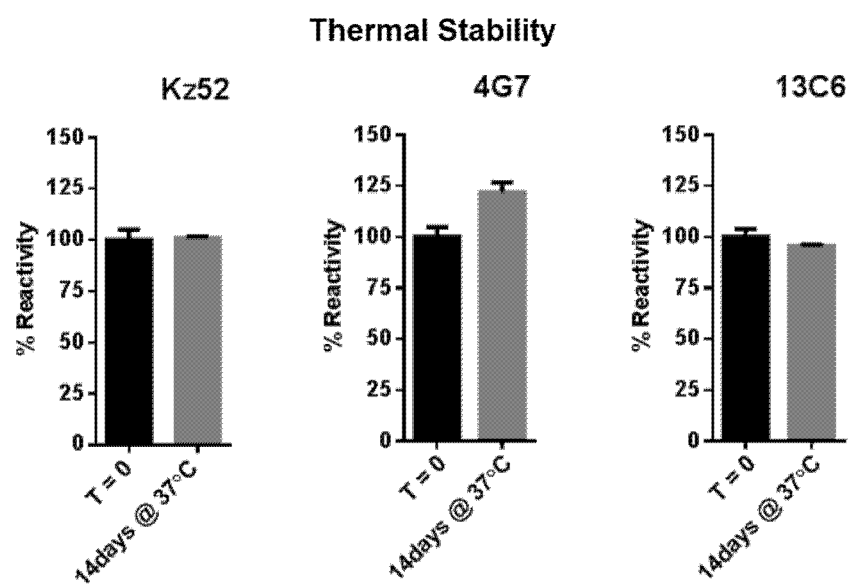
FIG. 11 is a graphical representation illustrating the thermal stability of Ebola GP clamp (lacking the mucin-like domain). Purified Ebola GP clamp (lacking the mucin-like domain) was bound to an ELISA plate and dried in the presence of 30% sucrose. Reactivity with highly neutralizing monoclonal antibodies Kz52, 4G7 and 13C6 (Murin et al., PNAS. 2014 11(48):17182-7) was measure either straight away or after 14 days incubation at 37° C. No significant change in reactivity was seen indicating that the clamp stabilized protein is stable at high temperatures for extended periods.

Protein conformation was assessed by SDS-PAGE in the presence and absence of reducing conditions, and with conformation specific monoclonal antibodies. The results presented in FIGS. 9 to 11 indicate that the EBOV GP delta mucin clamp chimeric fusion protein is stabilized in a pre-fusion conformation, and that this conformation is stable even at relatively high temperatures for extended periods (see, FIG. 11).

Animal Immunization

Figure 12:
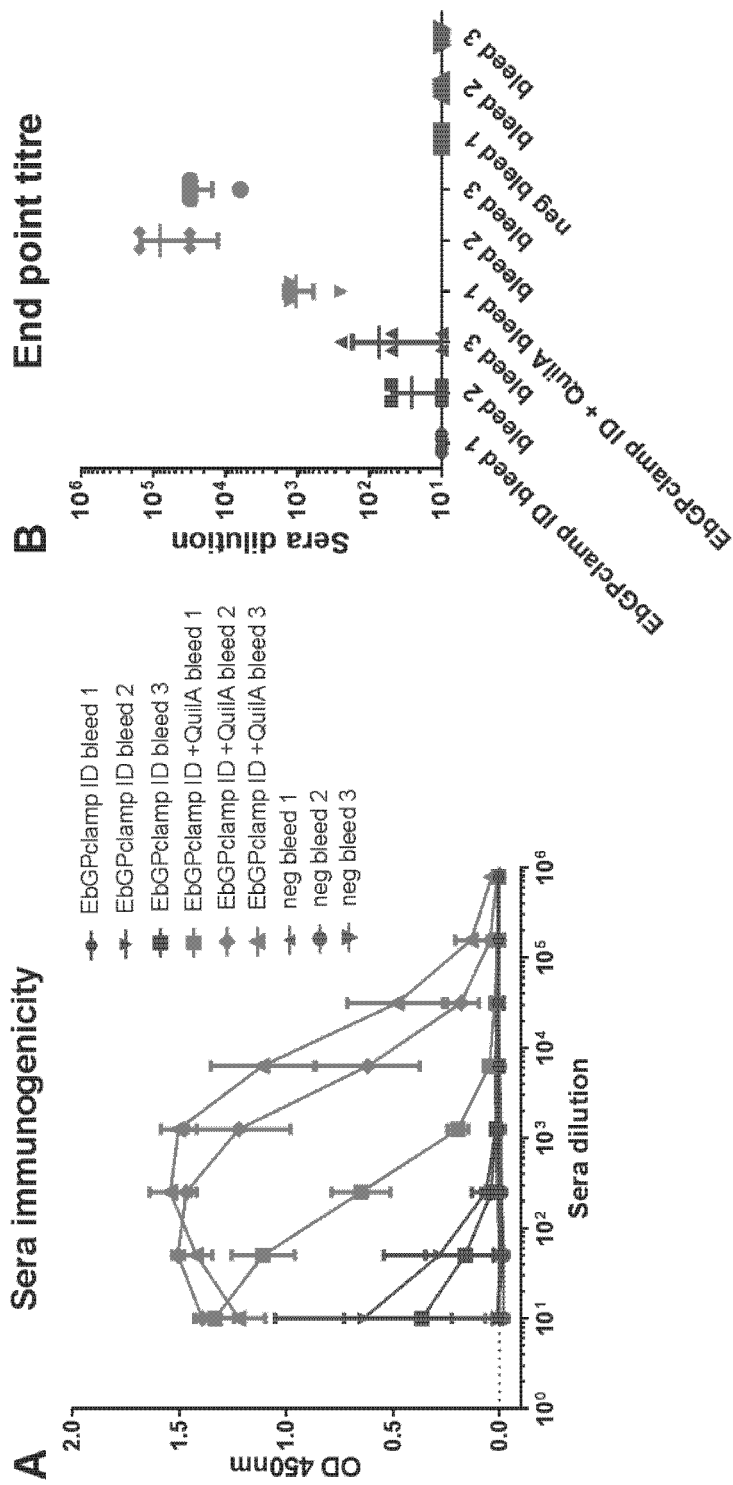
FIG. 12 is a graphical representation showing the immune response to Ebola GP clamp (lacking the mucin-like domain) following immunization of BALB/C mice. 3 groups of 5 mice were immunized intradermally with either 1 µg of Ebola GP clamp (lacking the mucin-like domain), 1 µg of Ebola GP clamp (lacking the mucin-like domain)+3 ug of Saponin adjuvant Quil A or PBS as a negative control. Mice were immunized 3 times at day 0, 28 and 56 and blood was collected at day 27 (bleed1), day 55 (bleed2) and day 84 (bleed3). A. Antibody specific for Ebola GP clamp (lacking the mucin-like domain) within blood serum was quantified by ELISA. B. Endpoint titre of was calculated by calculating the ultimate dilution capable of producing a reading above the background+3 standard deviations.
Figures 13, 14:
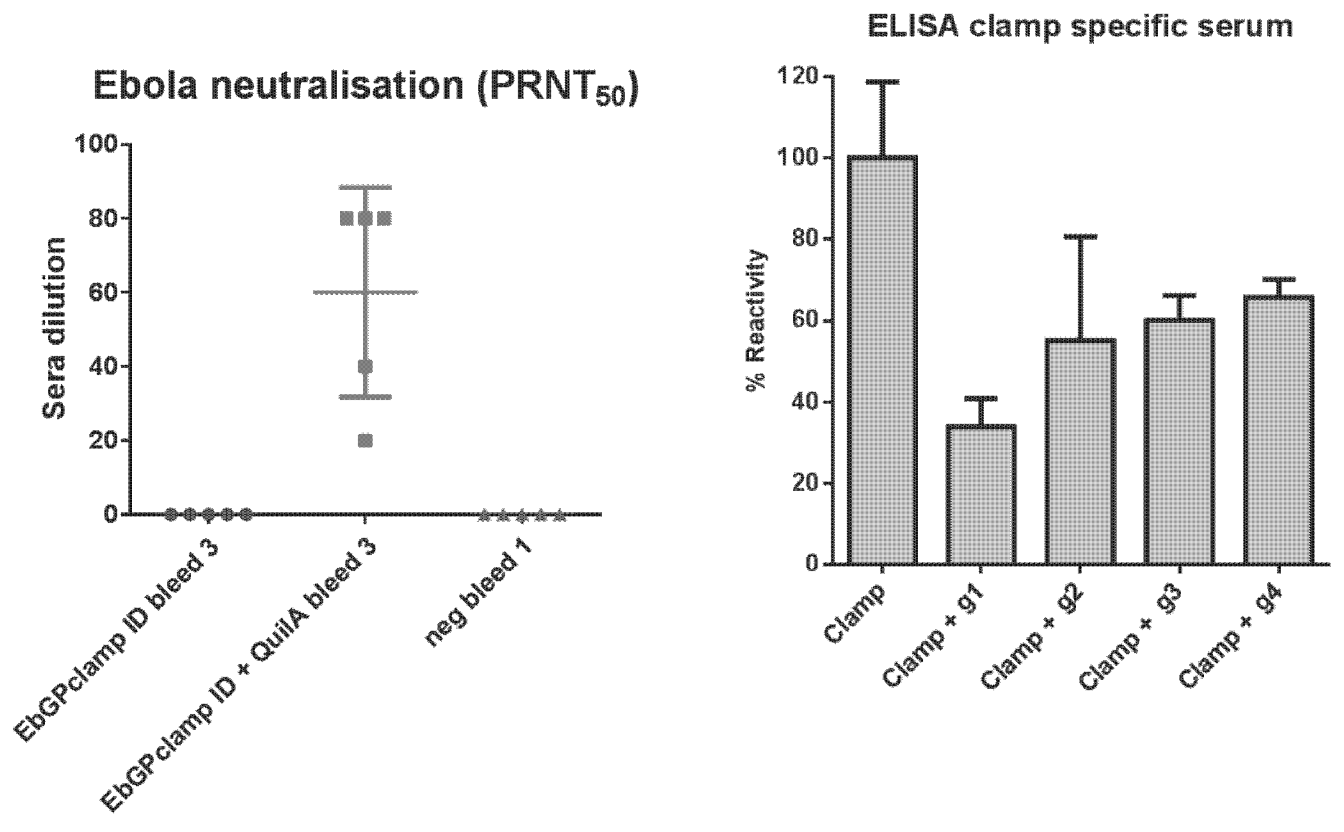

To further test the utility of the viral fusion proteins stabilized in their pre-fusion form via the incorporation of the 6-helix bundle forming moiety as immunogens, BALB/c mice were immunized with the chimeric clamp stabilized EBOV GP delta mucin construct. Five BALB/c mice per group were immunized with 1 µg of purified protein (or PBS) with or without 3 µg of saponin adjuvant Quil-A. Immunization was via intradermal delivery and mice were immunized three times, three weeks apart. Three weeks following the third immunization mice were sacrificed and sera collected. EBOV GP specific response was assessed after each immunization (FIG. 12) Neutralization effect of sera from each mouse was assessed against live ZEBOV under PC4 conditions at the Australian Animal Health Laboratory (AAHL) in a plaque reduction neutralization test (PRNT) (FIG. 13). Sera from mice vaccinated chimeric clamp stabilized EBOV GP delta mucin construct showed strong neutralizing activity with a geometric mean titer producing 50% reduction in plaque forming units calculated to be 52.8 (95% CI 24.5-114.0).

Example 5

Clamp Immunosilencing

This example illustrates the ability of the present invention to produce chimeric polypeptides, in which solvent exposed regions of the clamp sequence are modified to incorporate N-linked glycosylations. Representative evidence is provided for EBOV GP and these modifications are shown to facilitate shielding of the clamp domain from recognition by the adaptive immune system.

Materials and Methods

Chimeric Polypeptide Design

An EBOV GP lacking the mucin-like domain was operably connected to four different downstream heterologous SSMs, each comprising a pair of complementary HRA and HRB regions derived from HIV-1 GP160 in which individual HRB regions carried different mutations facilitating the incorporation of N-linked glycosylations. The amino acid sequence of these chimeric proteins are presented below.

```
EBOV GP ectodomain, minus mucin like domain
(1-311, 462-650)-HIV GP160-based SSM + G1:
                                      [SEQ ID NO: 153]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVGGNNTHHQDTGEESASSGKLGLITN

TIAGVAGLITGGRRTRREAIVNAQPKCNPNLHYWTTQDEGAAIGLAWI

PYFGPAAEGIYIEGLMHNQDGLICGLRQLANETTQALQLFLRATTELR

TFSILNRKAIDFLLQRWGGTCHILGPDCCIEPHDWTKNITDKIDQIIH

DFVDKTLPDQGDNDNWWTGWRQGGSGIVQQQNNLLRAIEAQQHLLQLT

VWGIKQLQARILAGGSGGTTWMNWTREINNYTSLIHSLIEESQNQQEK

NEQELLE

EBOV GP ectodomain, minus mucin like domain
(1-311, 462-650)-HIV GP160-based SSM + G2:
                                      [SEQ ID NO: 154]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVGGNNTHHQDTGEESASSGKLGLITN

TIAGVAGLITGGRRTRREAIVNAQPKCNPNLHYWTTQDEGAAIGLAWI

PYFGPAAEGIYIEGLMHNQDGLICGLRQLANETTQALQLFLRATTELR

TFSILNRKAIDFLLQRWGGTCHILGPDCCIEPHDWTKNITDKIDQIIH

DFVDKTLPDQGDNDNWWTGWRQGGSGIVQQQNNLLRAIEAQQHLLQLT

VWGIKQLQARILAGGSGGTTWMEWDREINNYTSLIHNLTEESQNQQEK

NEQELLE

EBOV GP ectodomain, minus mucin like domain
(1-311, 462-650)-HIV GP160-based SSM + G3:
                                      [SEQ ID NO: 155]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVGGNNTHHQDTGEESASSGKLGLITN

TIAGVAGLITGGRRTRREAIVNAQPKCNPNLHYWTTQDEGAAIGLAWI

PYFGPAAEGIYIEGLMHNQDGLICGLRQLANETTQALQLFLRATTELR

TFSILNRKAIDFLLQRWGGTCHILGPDCCIEPHDWTKNITDKIDQIIH

DFVDKTLPDQGDNDNWWTGWRQGGSGIVQQQNNLLRAIEAQQHLLQLT

VWGIKQLQARILAGGSGGTTWMEWDREINNYTSLIHSLIEESQNQTEK

NEQELLE

EBOV GP ectodomain, minus mucin like domain
(1-311, 462-650)-HIV GP160-based SSM + G4:
                                      [SEQ ID NO: 156]
MGVTGILQLPRDRFKRTSFFLWVIILFQRTFSIPLGVIHNSTLQVSDV

DKLVCRDKLSSTNQLRSVGLNLEGNGVATDVPSATKRWGFRSGVPPKV

VNYEAGEWAENCYNLEIKKPDGSECLPAAPDGIRGFPRCRYVHKVSGT

GPCAGDFAFHKEGAFFLYDRLASTVIYRGTTFAEGVVAFLILPQAKKD

FFSSHPLREPVNATEDPSSGYYSTTIRYQATGFGTNETEYLFEVDNLT

YVQLESRFTPQFLLQLNETIYTSGKRSNTTGKLIWKVNPEIDTTIGEW

AFWETKKNLTRKIRSEELSFTVVGGNNTHHQDTGEESASSGKLGLITN

TIAGVAGLITGGRRTRREAIVNAQPKCNPNLHYWTTQDEGAAIGLAWI

PYFGPAAEGIYIEGLMHNQDGLICGLRQLANETTQALQLFLRATTELR

TFSILNRKAIDFLLQRWGGTCHILGPDCCIEPHDWTKNITDKIDQIIH

DFVDKTLPDQGDNDNWWTGWRQGGSGIVQQQNNLLRAIEAQQHLLQLT

VWGIKQLQARILAGGSGGTTWMEWDREINNYTSLIHSLIEESQNQQEK

NENETLE
```

Protein Expression and Purification

Codon optimized DNA sequences encoding the above constructs were each incorporated into the pIRES-2 eukaryotic expression vector downstream of the CMV promoter. The resulting plasmids were transfected into CHO cells and transfected cells were grown and collected according to Example 1. Recombinant proteins were purified by affinity chromatography using mAb Kz52 (Murin et al., PNAS. 2014 11(48):17182-7).

Results

To test the potential to decrease recognition of the clamp by the adaptive immune system (immunosilencing) four separate mutations were introduced within the HRB of the clamp sequence based on the HIV GP160-based SSM which could facilitate the incorporation of N-linked glycosylations.

Chimeric EBOV GP (lacking the mucin-like domain) incorporating the modified GP160-based SSM were purified and the reactivity with Kz52 was assessed to confirm correct conformation of the purified proteins. The reactivity of sera from mice immunized with the chimeric clamp stabilized influenza HA was tested against Chimeric EBOV proteins incorporating the modified clamp sequences (FIG. 14). Reactivity was significantly reduced by glycosylation at each individual site supporting the hypothesis that this method can be used to reduce reactivity to the clamp domain.

Example 6

Purification of Clamp Stabilized Antigen from 8 Viruses

This example demonstrates the generic ability of the present invention to produce chimeric polypeptides that comprise an ectodomain of a viral fusion protein from a wide range of enveloped viruses and for these polypeptides to be purified by a monoclonal antibody specific to the clamp domain.

Materials and Methods

Chimeric Polypeptide Design

The ectodomain of INFA HA, RSV F, Nipah F and HSV2 gB is operably connected downstream to the heterologous structure stabilizing moiety that comprises a pair of complementary heptad repeat regions derived from HIV-1 GP160. The amino acid sequences of the resulting chimeric protein and their respective controls are presented below. For influenza the soluble ectodomain lacking a SSM was generated, as were controls incorporating the foldon SSM. For RSV-F, a non-essential region of the ectodomain (aa106-144) was removed from the design. The soluble ectodomain lacking a SSM was generated, as was a positive control produced described by McLellan et al. (*Science*, 2013. 342(6158): 592-598) was also produced that included mutations at 4 sites as (S155C, S290C, S190F and V207L and the foldon SSM. For Nipah and HSV non-stabilized controls were not produced.

```
Ectodomain of Influenza HA (A Switzerland 2013,
H3N2) (1-533):
                                    [SEQ ID NO: 157]
MGWSCIILFLVATATGVHSEQKLPGNDNSTATLCLGHHAVPNGTIVKT

ITNDRIEVTNATELVQNSSIGEICDSPHQILDGENCTLIDALLGDPQC

DGFQNKKWDLFVERSKAYSNCYPYDVPDYASLRSLVASSGTLEFNNES

FNWAGVTQNGTSSSCRRGSNSSFFSRLNWLTHLNSKYPALNVTMPNNE

QFDKLYIWGVHHPVTDKDQIFLYAQSSGRITVSTKRSQQAVIPNIGYR

PRIRDIPSRISIYWTIVKPGDILLINSTGNLIAPRGYFKIRSGKSSIM

RSDAPIGKCKSECITPNGSIPNDKPFQNVNRITYGACPRYVKQSTLKL

ATGMRNVPERQTRGIFGAIAGFIENGWEGMVDGWYGFRHQNSEGRGQA

ADLKSTQAAIDQINGKLNRLIGKTNEKFHQIEKEFSEVEGRIQDLEKY

VEDTKIDLWSYNAELLVALENQHTIDLTDSEMNKLFEKTKKQLRENAE

DMGNGCFKIYHKCDNACIGSIRNGTYDHDVYRDEALNNRFQIKGVELK

SGYKD.

Ectodomain of Influenza HA (A Switzerland 2013,
H3N2) (1-533)-Foldon SSM:
                                    [SEQ ID NO: 158]
MGWSCIILFLVATATGVHSEQKLPGNDNSTATLCLGHHAVPNGTIVKT

ITNDRIEVTNATELVQNSSIGEICDSPHQILDGENCTLIDALLGDPQC

DGFQNKKWDLFVERSKAYSNCYPYDVPDYASLRSLVASSGTLEFNNES

FNWAGVTQNGTSSSCRRGSNSSFFSRLNWLTHLNSKYPALNVTMPNNE

QFDKLYIWGVHHPVTDKDQIFLYAQSSGRITVSTKRSQQAVIPNIGYR

PRIRDIPSRISIYWTIVKPGDILLINSTGNLIAPRGYFKIRSGKSSIM

RSDAPIGKCKSECITPNGSIPNDKPFQNVNRITYGACPRYVKQSTLKL

ATGMRNVPERQTRGIFGAIAGFIENGWEGMVDGWYGFRHQNSEGRGQA

ADLKSTQAAIDQINGKLNRUGKTNEKFHQIEKEFSEVEGRIQDLEKYV

EDTKIDLWSYNAELLVALENQHTIDLTDSEMNKLFEKTKKQLRENAED

MGNGCFKIYHKCDNACIGSIRNGTYDHDVYRDEALNNRFQIKGVELKS

GYKDGGSAIGGYIPEAPRDGQAYVRKDGEWVLLSTFLGGLVPRGSGSA

WSHPQFEK.

Ectodomain of Influenza HA (A Switzerland 2013
H3N2) (1-533)-HIV GP160-based SSM:
                                    [SEQ ID NO: 159]
MGWSCIILFLVATATGVHSEQKLPGNDNSTATLCLGHHAVPNGTIVKT

ITNDRIEVTNATELVQNSSIGEICDSPHQILDGENCTLIDALLGDPQC

DGFQNKKWDLFVERSKAYSNCYPYDVPDYASLRSLVASSGTLEFNNES

FNWAGVTQNGTSSSCRRGSNSSFFSRLNWLTHLNSKYPALNVTMPNNE

QFDKLYIWGVHHPVTDKDQIFLYAQSSGRITVSTKRSQQAVIPNIGYR

PRIRDIPSRISIYWTIVKPGDILLINSTGNLIAPRGYFKIRSGKSSIM

RSDAPIGKCKSECITPNGSIPNDKPFQNVNRITYGACPRYVKQSTLKL

ATGMRNVPERQTRGIFGAIAGFIENGWEGMVDGWYGFRHQNSEGRGQA

ADLKSTQAAIDQINGKLNRLIGKTNEKFHQIEKEFSEVEGRIQDLEKY

VEDTKIDLWSYNAELLVALENQHTIDLTDSEMNKLFEKTKKQLRENAE

DMGNGCFKIYHKCDNACIGSIRNGTYDHDVYRDEALNNRFQIKGVELK

SGYKDGSGIVQQQNNLLRAIEAQQHLLQLTVWGIKQLQARILAGGSGG

HTTWMEWDREINNYTSLIHSLIEESQNQPAKDEQELLE.

Ectodomain of Influenza HA (A California 2009,
H1N1pdm) (1-526):
                                    [SEQ ID NO: 160]
MKVKLLVLLCTFATANADTLCIGYHANNSTDTVDTVLEKNVTVTHSVN

LLEDKHNGKLCKLRGVAPLHLGKCNIAGWILGNPECESLSTASSWSYI

VETPSSDNGTCYPGDFIDYEELREQLSSVSSFERFEIFPKTSSWPNHD

SNKGVTAACPHAGAKSFYKNLIWLVKKGNSYPKLSKSYINDKGKEVLV

LWGIHHPSTSADQQSLYQNADTYVFVGSSRYSKKFKPEIAIRPKVRDQ

EGRMNYYWTLVEPGDKITFEATGNLVVPRYAFAMERNAGSGIIISDTP

VHDCNTTCQTPKGAINTSLPFQNIHPITIGKCPKYVKSTKLRLATGLR

NIPSIQSRGLFGAIAGFIEGGWTGMVDGWYGYHHQNEQGSGYAADLKS

TQNAIDEITNKVNSVIEKMNTQFTAVGKEFNHLEKRIENLNKKVDDGF
```

Ectodomain of Influenza HA (A California 2009, H1N1pdm) (1-526)-Foldon SSM:

[SEQ ID NO: 161]
MKVKLLVLLCTFATANADTLCIGYHANNSTDTVDTVLEKNVTVTHSVN
LLEDKHNGKLCKLRGVAPLHLGKCNIAGWILGNPECESLSTASSWSYI
VETPSSDNGTCYPGDFIDYEELREQLSSVSSFERFEIFPKTSSWPNHD
SNKGVTAACPHAGAKSFYKNLIWLVKKGNSYPKLSKSYINDKGKEVLV
LWGIHHPSTSADQQSLYQNADTYVFVGSSRYSKKFKPEIAIRPKVRDQ
EGRMNYYWTLVEPGDKITFEATGNLVVPRYAFAMERNAGSGIIISDTP
VHDCNTTCQTPKGAINTSLPFQNIHPITIGKCPKYVKSTKLRLATGLR
NIPSIQSRGLFGAIAGFIEGGWTGMVDGWYGYHHQNEQGSGYAADLKS
TQNAIDEITNKVNSVIEKMNTQFTAVGKEFNHLEKRIENLNKKVDDGF
LDIWTYNAELLVLLENERTLDYHDSNVKNLYEKVRSQLKNNAKEIGNG
CFEFYHKCDNTCMESVKNGTYDYPKYSEEAKLNREEIDGVKLESTRGG
SAIGGYIPEAPRDGQAYVRKDGEWVLLSTFLGGLVPRGSGSAWSHPQF
EK.

Ectodomain of Influenza HA (A California 2009, H1N1pdm) (1-526)-HIV GP160-based SSM:

[SEQ ID NO: 162]
MMKVKLLVLLCTFATANADTLCIGYHANNSTDTVDTVLEKNVTVTHSV
NLLEDKHNGKLCKLRGVAPLHLGKCNIAGWILGNPECESLSTASSWSY
IVETPSSDNGTCYPGDFIDYEELREQLSSVSSFERFEIFPKTSSWPNH
DSNKGVTAACPHAGAKSFYKNLIWLVKKGNSYPKLSKSYINDKGKEVL
VLWGIHHPSTSADQQSLYQNADTYVFVGSSRYSKKFKPEIAIRPKVRD
QEGRMNYYWTLVEPGDKITFEATGNLVVPRYAFAMERNAGSGIIISDT
PVHDCNTTCQTPKGAINTSLPFQNIHPITIGKCPKYVKSTKLRLATGL
RNIPSIQSRGLFGAIAGFIEGGWTGMVDGWYGYHHQNEQGSGYAADLK
STQNAIDEITNKVNSVIEKMNTQFTAVGKEFNHLEKRIENLNKKVDDG
FLDIWTYNAELLVLLENERTLDYHDSNVKNLYEKVRSQLKNNAKEIGN
GCFEFYHKCDNTCMESVKNGTYDYPKYSEEAKLNREEIDGVKLESTRG
SGIVQQQNNLLRAIEAQQHLLQLTVWGIKQLQARILAGGSGGHTTWME
WDREINNYTSLIHSLIEESQNQPAKDEQELLE.

Ectodomain of RSV F (1-516)-His tag:

[SEQ ID NO: 163]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVSKVLHLEGEVNKIKSALLSTNKAVVSLSNGVSVLTSKV
LDLKNYIDKQLLPIVNKQSCSISNIETVIEFQQKNNRLLEITREFSVN
AGVTTPVSTYMLTNSELLSLINDMPITNDQKKLMSNNVQIVRQQSYSI
MSIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCKIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLHNVGGGHHHHHH.

Ectodomain of RSV F (1-513)-DScav mutations-Foldon SSM:

[SEQ ID NO: 164]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNRARRELPRFMNYTLNNAKKTNVTLSKKRKRRFLGFLLGV
GSAIASGVAVCKVLHLEGEVNKIKSALLSTNKAVVSLSNGVSVLTFKV
LDLKNYIDKQLLPILNKQSCSISNIETVIEFQQKNNRLLEITREFSVN
AGVTTPVSTYMLTNSELLSLINDMPITNDQKKLMSNNVQIVRQQSYSI
MCIIKEEVLAYVVQLPLYGVIDTPCWKLHTSPLCTTNTKEGSNICLTR
TDRGWYCDNAGSVSFFPQAETCKVQSNRVFCDTMNSLTLPSEVNLCNV
DIFNPKYDCKIMTSKTDVSSSVITSLGAIVSCYGKTKCTASNKNRGII
KTFSNGCDYVSNKGVDTVSVGNTLYYVNKQEGKSLYVKGEPIINFYDP
LVFPSDEFDASISQVNEKINQSLAFIRKSDELLSAI*GGYIPEAPRDGQ*
*AYVRKDGEWVLLSTFLGGLVPRGSGSAWSHPQFEK*

Ectodomain of RSV F (1-105, 145-511)-HIV GP160-based SSM:

[SEQ ID NO: 165]
MELLILKANAITTILTAVTFCFASGQNITEEFYQSTCSAVSKGYLSAL
RTGWYTSVITIELSNIKKNKCNGTDAKVKLIKQELDKYKNAVTELQLL
MQSTQATNNGSGSAIASGVAVSKVLHLEGEVNKIKSALLSTNKAVVSL
SNGVSVLTSKVLDLKNYIDKQLLPIVNKQSCSISNIETVIEFQQKNNR
LLEITREFSVNAGVTTPVSTYMLTNSELLSLINDMPITNDQKKLMSNN
VQIVRQQSYSIMSIIKEEVLAYVVQLPLYGVIDTPCWKLHTSPLCTTN
TKEGSNICLTRTDRGWYCDNAGSVSFFPQAETCKVQSNRVFCDTMNSL
TLPSEVNLCNVDIFNPKYDCKIMTSKTDVSSSVITSLGAIVSCYGKTK
CTASNKNRGIIKTFSNGCDYVSNKGVDTVSVGNTLYYVNKQEGKSLYV
KGEPIINFYDPLVFPSDEFDASISQVNEKINQSLAFIRKSDEGSGIVQ
QQNNLLRAIEAQQHLLQLTVWGIKQLQARILAGGSGGHTTWMEWDREI
NNYTSLIHSLIEESQNQQEKNEQELLE.

Ectodomain of Nipah F (1-483)-HIV GP160-based SSM

[SEQ ID NO: 166]
MVVILDKRCYCNLLILILMISECSVGILHYEKLSKIGLVKGVTRKYKI
KSNPLTKDIVIKMIPNVSNMSQCTGSVMENYKTRLNGILTPIKGALEI
YKNNTHDLVGDVRLAGVIMAGVAIGIATAAQITAGVALYEAMKNADNI
NKLKSSIESTNEAVVKLQETAEKTVYVLTALQDYINTNLVPTIDKISC
KQTELSLDLALSKYLSDLLFVFGPNLQDPVSNSMTIQAISQAFGGNYE
TLLRTLGYATEDFDDLLESDSITGQIIYVDLSSYYIIVRVYFPILTEI
QQAYIQELLPVSFNNDNSEWISIVPNFILVRNTLISNIEIGFCLITKR
SVICNQDYATPMTNNMRECLTGSTEKCPRELVVSSHVPRFALSNGVLF
ANCISVTCQCQTTGRAISQSGEQTLLMIDNTTCPTAVLGNVIISLGKY

-continued

LGSVNYNSEGIAIGPPVFTDKVDISSQISSMNQSLQQSKDYIKEAQRL

LDTGSGIVQQQNNLLRAIEAQQHLLQLTVWGIKQLQARILAGGSGGHT

TWMEWDREINNYTSLIHSLIEESQNQQEKNEQELLE.

Ectodomain of HSV1 gB (28-741)-IgK signal
peptide-HIV GP160-based SSM:

[SEQ ID NO: 167]
MGWSCIILFLVATATGVHSERASGDVAATVAANGGPASQPPPVPSPAT

TKARKRKTKKPPKRPEATPPPDANATVAAGHATLRAHLREIKVENADA

QFYVCPPPTGATVVQFEQPRRCPTRPEGQNYTEGIAVVFKENIAPYKF

KATMYYKDVTVSQVWFGHRYSQFMGIFEDRAPVPFEEVIDKINAKGVC

RSTAKYVRNNMETTAFHRDDHETDMELKPAKVATRTSRGWHTTDLKYN

PSRVEAFHRYGTTVNCIVEEVDARSVYPYDEFVLATGDFVYMSPFYGY

REGSHTEHTSYAADRFKQVDGFYARDLTTKARATSPTTRNLLTTPKFT

VAWDWVPKRPAVCTMTKWQEVDEMLRAEYGGSFRFSSDAISTTFTTNL

TQYSLSRVDLGDCIGRDAREAIDRMFARKYNATHIKVGQPQYYLATGG

FLIAYQPLLSNTLAELYVREYMREQDRKPRNATPAPLREAPSANASVE

RIKTTSSIEFARLQFTYNHIQRHVNDMLGRIAVAWCELQNHELTLWNE

ARKLNPNAIASATVGRRVSARMLGDVMAVSTCVPVAPDNVIVQNSMRV

SSRPGTCYSRPLVSFRYEDQGPLIEGQLGENNELRLTRDALEPCTVGH

RRYFIFGGGYVYFEEYAYSHQLSRADVTTVSTFIDLNITMLEDHEFVP

LEVYTRHEIKDSGLLDYTEVQRRNQLHDLRFADIDTVIRADANAAMFA

GLCAFFEGMGDLGRGGGGSGIVQQQNNLLRAIEAQQHLLQLTVWGIKQ

LQARILAGGSGGHTTWMEWDREINNYTSLIHSLIEESQNQQEKNEQEL

LE.

Ectodomain of Measles F (1-488)-HIV GP160-
based SSM:

[SEQ ID NO: 168]
MGLKVNVSAIFMAVLLTLQTPTGQIHWGNLSKIGVVGIGSASYKVMTR

SSHQSLVIKLMPNITLLNNCTRVEIAEYRRLLRTVLEPIRDALNAMTQ

NIRPVQSVASSRRHKRFAGVVLAGAALGVATAAQITAGIALHQSMLNS

QAIDNLRASLETTNQAIEAIRQAGQEMILAVQGVQDYINNELIPSMNQ

LSCDLIGQKLGLKLLRYYTEILSLFGPSLRDPISAEISIQALSYALGG

DINKVLEKLGYSGGDLLGILESRGIKARITHVDTESYFIVLSIAYPTL

SEIKGVIVHRLEGVSYNIGSQEWYTTVPKYVATQGYLISNFDESSCTF

MPEGTVCSQNALYPMSPLLQECLRGSTKSCARTLVSGSFGNRFILSQG

NLIANCASILCKCYTTGTIINQDPDKILTYIAADHCPVVEVNGVTIQV

GSRRYPDAVYLHRIDLGPPISLERLDVGTNLGNAIAKLEDAKELLESS

DQILRSMKGGRSGIVQQQNNLLRAIEAQQHLLQLTVWGIKQLQARILA

GGSGGHTTWMEWDREINNYTSLIHSLIEESQNQQEKNEQELLE.

Ectodomain of Lassa virus GPC (1-423)-HIV
GP160-based SSM:

[SEQ ID NO: 169]
MGQIVTFFQEVPHVIEEVMNIVLIALSVLAVLKGLYNFATCGLVGLVT

FLLLCGRSCTTSLYKGVYELQTLELNMETLNMTMPLSCTKNNSHHYIM

VGNETGLELTLTNTSIINHKFCNLSDAHKKNLYDHALMSIISTFHLSI

-continued

PNFNQYEAMSCDFNGGKISVQYNLSHSYAGDAANHCGTVANGVLQTFM

RMAWGGSYIALDSGRGNWDCIMTSYQYLIIQNTTWEDHCQFSRPSPIG

YLGLLSQRTRDIYISRRLLGTFTWTLSDSEGKDTPGGYCLTRWMLIEA

ELKCFGNTAVAKCNEKHDEEFCDMLRLFDFNKQAIQRLKAEAQMSIQL

INKAVNALINDQLIMKNHLRDIMGIPYCNYSKYWYLNHTTTGRTSLPK

CWLVSNGSYLNETHFSDDIEQQADNMITEMLQKEYMERQGSGIVQQQN

NLLRAIEAQQHLLQLTVWGIKQLQARILAGGSGGHTTWMEWDREINNY

TSLIHSLIEESQNQQEKNEQELLE.

Protein Expression and Purification

Codon optimized DNA sequences encoding the chimeric fusion proteins, Influenza H1 foldon, Influenza H1 clamp, Influenza H3 foldon, Influenza H3 clamp, RSV F clamp, RSV F ds cav Foldon, MERS S clamp and Ebola GP clamp delta mucin, Nipah virus F clamp, Measles virus F clamp, Lassa virus GPC clamp, Herpes Simplex 2 virus gB clamp (as well as the corresponding ectodomains of RSV F and Influenza H3 lacking HIV-1 HRA and HRB sequences) were incorporated into the pIRES-2 or pNBF eukaryotic expression vector following the CMV promoter. The resulting plasmids were transfected into Chinese hamster ovary (CHO) cells grown in chemically defined CHO (CD-CHO) media (Gibco) or in ExpiCHO expression media (Gibco). CHO cells were transfected by either combining 600 µg plasmid and 2.4 mg of linear polyethylenimine in 300 mL of CHO cells at a density of $1 \times 10^6$ cells per mL or 16 µg plasmid with 640 µl OPTI-pro serum free media (SFM), and 51.2 µl of expifectamine (Gibco). After 4 h of incubation CHO cells transfected with linear polyethylenimine were pelleted, media containing transfection reagent was removed and cells were resuspended in 300 mL of CD-CHO containing 8 mM Glutamax (Gibco), 100 units/mL of penicillin (Gibco), 100 µg/mL of streptomycin (Gibco), 7.5% CHO CD Efficient Feed A (Gibco), and 7.5% CHO CD Efficient Feed B (Gibco). For cells transfected with Expifectamine, after 24 h incubation 96 µl of ExpiCHO enhancer and 3.84 ml of ExpiCHO feed was added. Both sets of cells were then incubated for 7 days at 37° C., 7.5% C02, shaking at ~120 rpm. After 7 days cells were removed by centrifugation for 10 min at 6,000×g and supernatant was filtered.

Recombinant proteins were purified by affinity chromatography with specific monoclonal antibodies covalently coupled to HiTrap NHS-activated HP columns (GE). Chimeric clamp stabilized Influenza HA, RSV F, MERS S, Ebola GP, Lassa GPC, Nipah F, Measles F and HSV2 gB were purified by mAb 1281 (Frey, et al., Nat Struct Mol Biol. 2010. 17(12):1486-91) which binds to the 6-helix bundle formed by HIV-1 HRA and HRB. Chimeric clamp stabilized and foldon stabilized Influenza H1 and the corresponding ectodomain for H1 were purified with mAb 5J8 (Hong, et al., J Virol, 2013. 87(22): p. 12471-80). Chimeric clamp stabilized and foldon stabilized Influenza H3 and the corresponding ectodomain for H3 were purified with mAb C05 (Ekiert, et al., Nature, 2012. 489(7417): 526-32). Chimeric clamp stabilized and foldon stabilized RSV F incorporating ds cav mutations as well as the corresponding ectodomain of RSV F were purified with mAb 101F (McLellan, et al. J Virol. 2010. 84(23):12236-44). Purification of the desired protein was confirmed by SDS-PAGE.

Results

Molecular Clamp as a Generic Method for Protein Expression and Purification

Figures 15, 16:
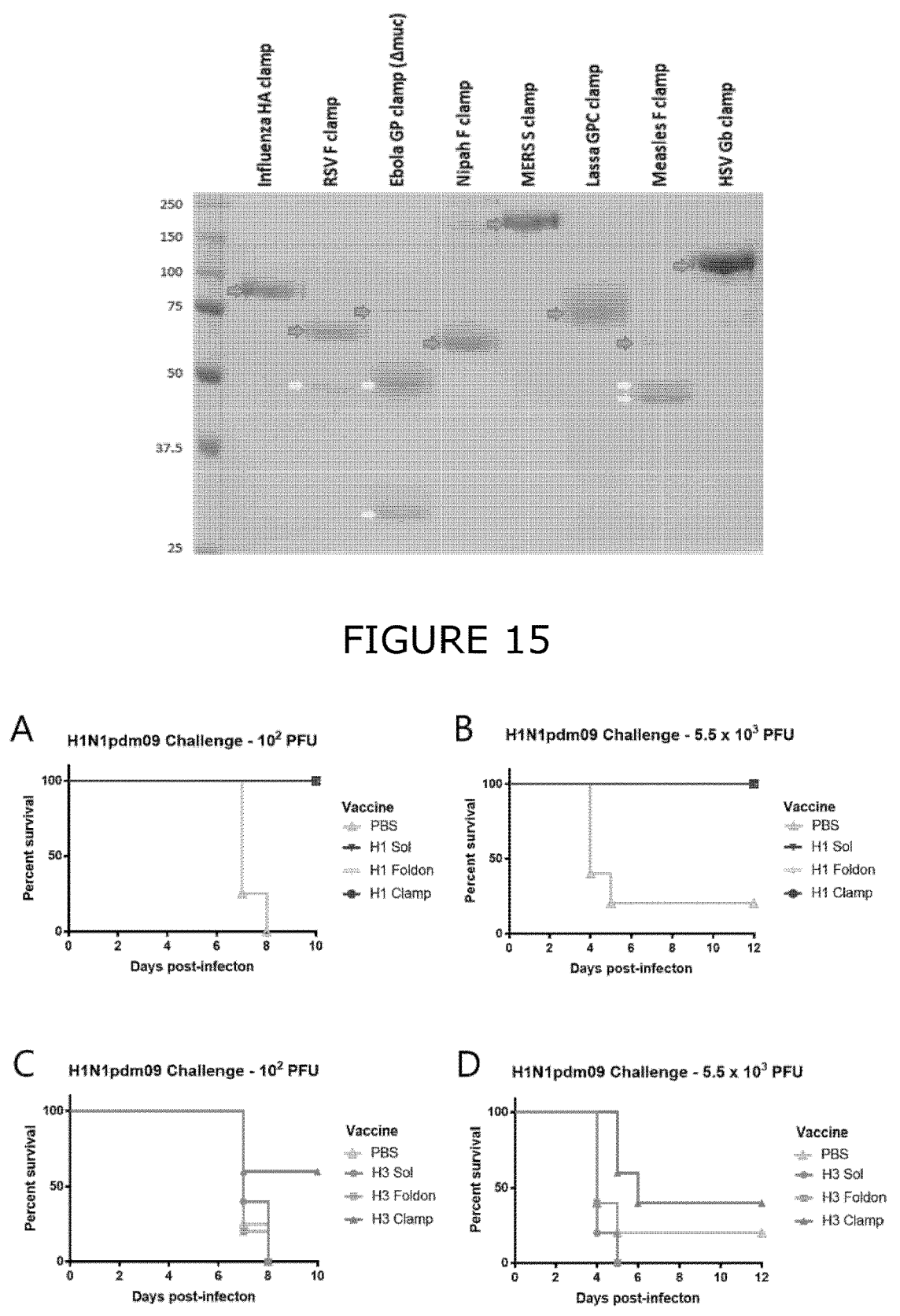

Expression and purification of chimeric clamp stabilized viral fusion proteins from eight viruses was confirmed by SDS-PAGE (FIG. 15). Incorporation of the SSM based on HIV-1 GP160 HR1 and HR2 sequences downstream of ectodomains allows recovery of diverse chimeric proteins using the by mAb 1281 (Frey, et al., Nat Struct Mol Biol. 2010. 17(12):1486-91) which binds to the 6-helix bundle formed by HIV-1 HRA and HRB.

Mouse Protection Study Following Challenge with Influenza Virus H1N1pdm

To extend results showing inclusion of the 6-helix bundle forming moiety into the influenza HA ectodomain can elicit a broadly cross-reactive immune response, we conducted an influenza challenge experiment within C57b mice. This study also set out to directly compare the molecular clamp the 6-helix bundle forming moiety with the foldon SSM with regard to the induction of broad-spectrum cross-protection from divergent influenza subtypes. C57b mice were vaccinated with either PBS, H1sol, H3sol, H1foldon, H3foldon, H1clamp or H3clamp. Vaccines were dose matched, each containing 5 µg of HA and 3 µg of QuilA with mice receiving three doses of vaccine given two weeks apart. Mice were then challenged with Influenza Cal/09 (H1N1pdm) six weeks after the initial dose (n=5 mice per group). This study was designed to assess both protection against an identical strain and protection against a highly divergent subtype. Mice were challenged via the intranasal route with influenza A virus H1N1pdm at a 'low dose' of $1\times10^2$ plaque-forming units (PFU) and a 'high dose' of $5.5\times10^3$ PFU. Weight loss was measured daily over a 14-day period with mice culled if they lost >20% of their original body weight.

This study confirmed that H1clamp is able to provide complete protection against a matched strain of influenza, as did H1sol and H1foldon (FIGS. 16A and B). Of particular interest, immunization with H3clamp also showed partial protection against influenza H1N1pdm. For H3clamp 3/5 mice survived when challenged with the low dose influenza H1N1pdm and 2/5 mice survived when challenged with the high dose influenza H1N1pdm (FIGS. 16C and D). In comparison none of the mice immunized with H3sol nor H3 foldon survived when challenged with either the low or high dose of influenza H1N1pdm, and only 1/5 mice mock immunized with PBS survived when challenged with the low dose of influenza H1N1pdm. A comparison between mice surviving H1N1pdm after H3clamp vaccination (5/10) compared to mice surviving after mock vaccination or vaccination with H3sol or H3 foldon (1/30), demonstrates the statistical significance of broad spectrum influenza protection being mediated by H3clamp (p=0.0003; chi square calculator). As H3 and H1 subtypes belong to separate groups within the influenza phylogenetic tree this result indicates a broad level of protection and it can be reasonably expected that broad spectrum all influenza strains and subtypes which are equally or less divergent.

Increased Thermal Stability Upon Inclusion of the Clamp SSM

Figure 17:
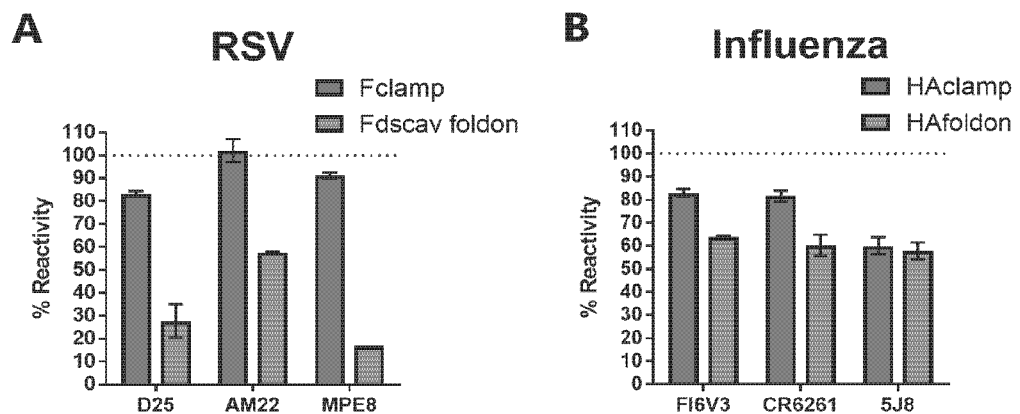
FIG. 17 is a graphical representation showing thermal stability of clamp stabilized antigens at 43° C. for 72 hrs. Clamp stabilized vaccine candidates and control proteins were incubated at 43° C. for 72 hrs. and the reactivity with three well characterized mAbs for each antigen used as a measure of thermal stability A. Pre-fusion specific mAbs D25, AM22 and MPE8 were used to compare RSV Fclamp and the alternate approach utilizing the foldon trimerization domain and structure based stabilizing mutations (McLellan et al., Science, 2013. 342(6158): p. 592-8). B. HA stem specific mAbs FI6V3 and CR6261 and HA head specific mAb 538 were used to compare Influenza H1clamp and alternate approach utilizing the foldon trimerization domain.

To directly compare stability afforded by the clamp SSM and the foldon SSM, purified antigens Influenza H1 foldon, Influenza H1 clamp, RSV F ds cav foldon, and RSV F clamp were incubated at 43° C. for 72 hrs and the reactivity with mAbs used as a measure of thermal stability. For the RSV F comparison three pre-fusion specific mAbs were used, D25 (McLellan et al., Science, 2013. 340(6136): p. 1113-7), MPE8 (Corti et al., Nature, 2013. 501(7467): p. 439-43) and AM22 (McLellan et al., Science, 2013. 340(6136): p. 1113-7). For the influenza HA comparison two stem specific mAbs were used, CR6261 (Ekiert et al., Science, 2009. 324(5924): p. 246-51) and Fi6V3 (Corti et al., Science, 2011. 333(6044): p. 850-6), and one head specific mAb was used, 5J8 (Hong, et al., J Virol, 2013. 87(22): p. 12471-80). Direct comparison revealed that RSV F clamp retained significantly higher reactivity with prefusion specific mAbs than RSV F ds cav foldon following incubation at elevated temperature (FIG. 17A). Similarly, direct comparison revealed that influenza H1clamp retained significantly higher reactivity with HA stem specific mAbs than influenza H1 foldon (FIG. 17B). Retention of reactivity with the head specific mAb was comparable between influenza H1 clamp and influenza H1 foldon. Together these results demonstrates the superior stability of the clamp SSM compared to the foldon SSM.

Neutralizing Immune Response Induced by RSV F Clamp

Figure 18:
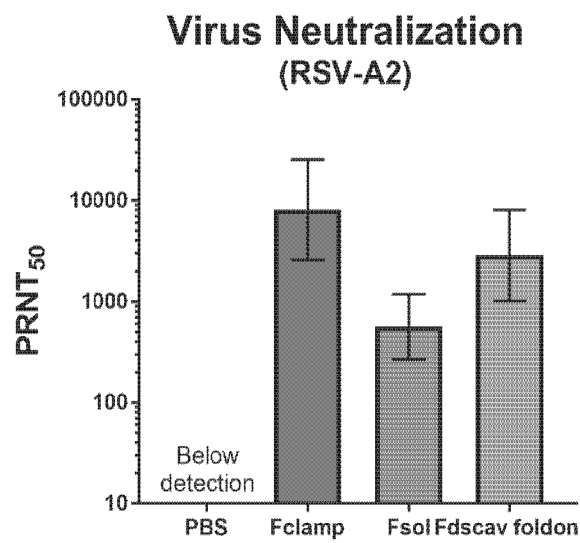
FIG. 18 is a graphical representation showing immune response to clamp-stabilized subunit vaccines. Sera from mice immunized with RSV Fclamp, Fsol or Fdscav foldon (McLellan et al., *Science,* 2013. 342(6158):592-598) was tested for its ability to neutralize RSV.

To test the utility of the viral fusion proteins stabilized in their pre-fusion form via the incorporation of the 6-helix bundle forming moiety as immunogens, BALB/c mice were immunized with the RSV F clamp, RSV F ds cav foldon, the corresponding RSV ectodomain (RSV F sol) or mock immunized with PBS. Five BALB/c mice per group were immunized with 5 µg of purified protein (or PBS) with 3 µg of saponin adjuvant Quil-A. Immunization was via intradermal delivery and mice were immunized three times each three weeks apart. Three weeks following the third immunization mice were sacrificed and sera collected. Neutralization effect of sera from individual mice was assessed against RSV strain A2 in a plaque reduction neutralization test (PRNT) (FIG. 18). Sera from mice vaccinated chimeric clamp stabilized RSV F clamp showed strong neutralizing activity with a geometric mean IC50 value of 8,124 (95% CI=1, 968-33,543), while sera from mice vaccinated with the RSV F ds cav foldon showed neutralizing activity with a geometric mean IC50 value of 2,859 (95% CI=794-10,290) and sera from mice vaccinated with the RSV F sol showed neutralizing activity with an a geometric mean IC50 value of 562 (95% CI=242-1,410). Therefore, stabilization of the pre-fusion form of the RSV F via the incorporation of a structure-stabilizing moiety comprised of HIV-1 HR1 and HR2 is critical for a strong neutralizing immune response, which is approximately 3-fold higher than that induced by the alternate stabilization approach 'ds cav foldon' (McLellan et al., Science, 2013. 342(6158): p. 592-8).

Stabilization of the Prefusion Conformation of Nipah Virus F

Figures 19, 20:
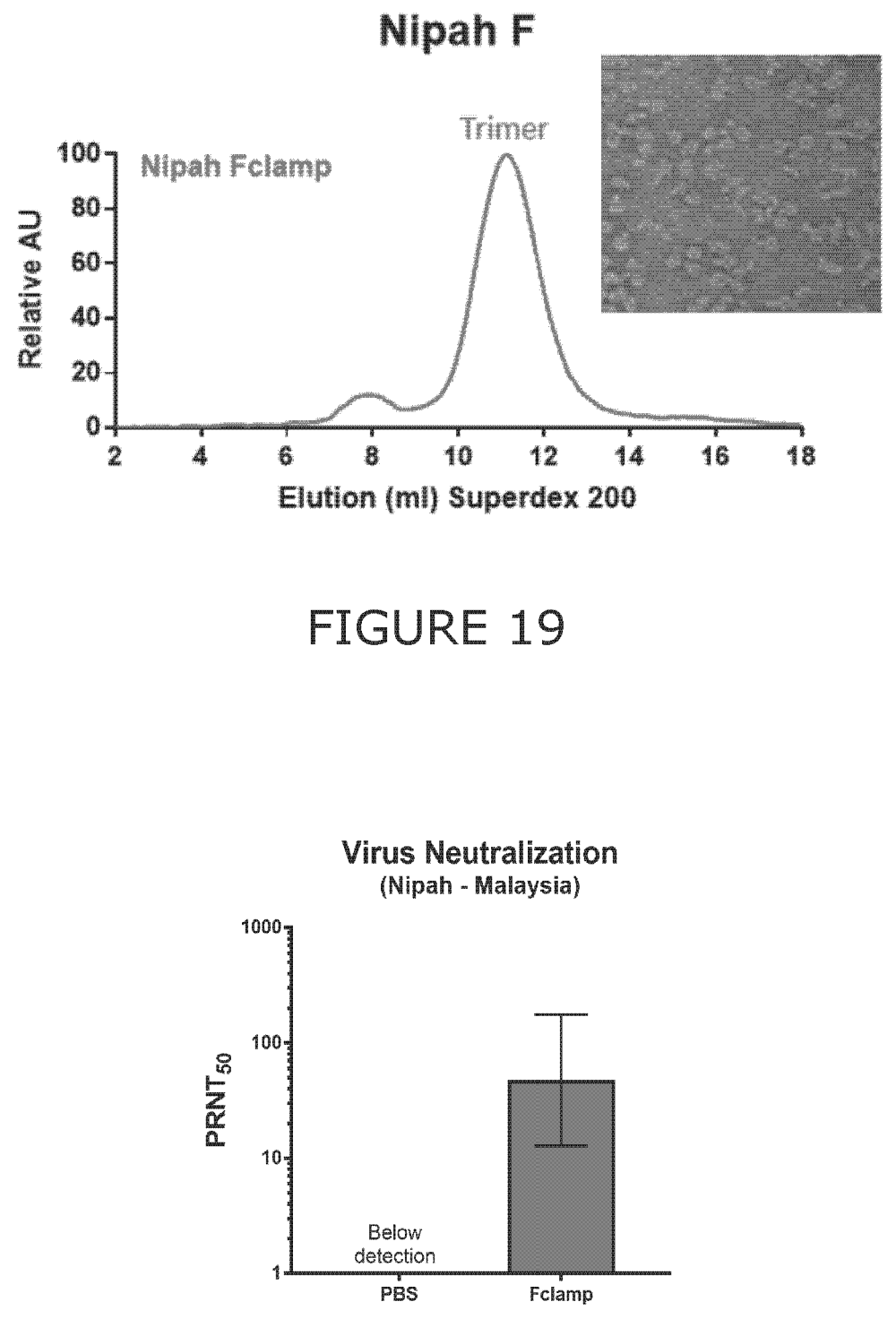

To further validate the utility of the clamp SSM to stabilize the prefusion conformation of viral fusion proteins the clamp SSM was incorporated into the ectodomain of Nipah virus F and expressed in CHO cells. Protein purified by immunoaffinity chromatography was then analyzed by size exclusion chromatography using a superdex 200 column. The major portion of the Nipah virus F clamp eluted at approximately 11.5 mL which is equivalent to roughly the expected size of the trimeric protein, ~180 kDa (FIG. 19). As has been well demonstrated for Paramyxovirus F (Connolly et al., PNAS, 2006. 103(47): P. 17903-8), transition of the Nipah virus F into the post-fusion conformation would be expected to result in the exposure of the hydrophobic fusion peptide thereby driving protein aggregation. The presence of the soluble trimeric protein is therefore evidence supporting the presence of the pre-fusion conformation. Purified Nipah virus F clamp was also analyzed by negative stain transmission electron microscopy (TEM) (FIG. 19, inset). Within the TEM image presented, it is clearly visible that particles of Nipah virus F clamp have a homogenous size and a topology consistent with the expected prefusion conformation. The data presented further supports the ability of the clamp SSM to stabilize the prefusion conformation of viral fusion proteins.

Neutralizing Immune Response Induced by Nipah Virus F Clamp

To further test the utility of the viral fusion proteins stabilized in their pre-fusion form via the incorporation of the 6-helix bundle forming moiety as immunogens, BALB/c mice were immunized with the Nipah virus F clamp or mock immunized with PBS. Four BALB/c mice per group were immunized with 5 µg of purified protein (or PBS) with 3 µg of saponin adjuvant Quil-A. Immunization was via intradermal delivery and mice were immunized twice, three weeks apart. Three weeks following the second immunization mice were sacrificed and sera collected. Neutralization effect of sera from individual mice was assessed against live Nipah virus (Malaysian strain) in a plaque reduction neutralization test (PRNT) under BSL4 containment (FIG. 20). Sera from mice vaccinated chimeric clamp stabilized Nipah virus F clamp all showed strong neutralizing activity with a geometric mean IC50 value of 48 (95% CI=6-384), while sera from mice mock immunized with PBS showed no neutralizing activity at the highest serum concentration tested. This result therefore provides further evidence that chimeric viral fusion proteins incorporating the clamp SSM are able to elicit a neutralizing immune response upon vaccination.

Incorporation of the Clamp SSM into a Class III Viral Fusion Protein

Figure 21:
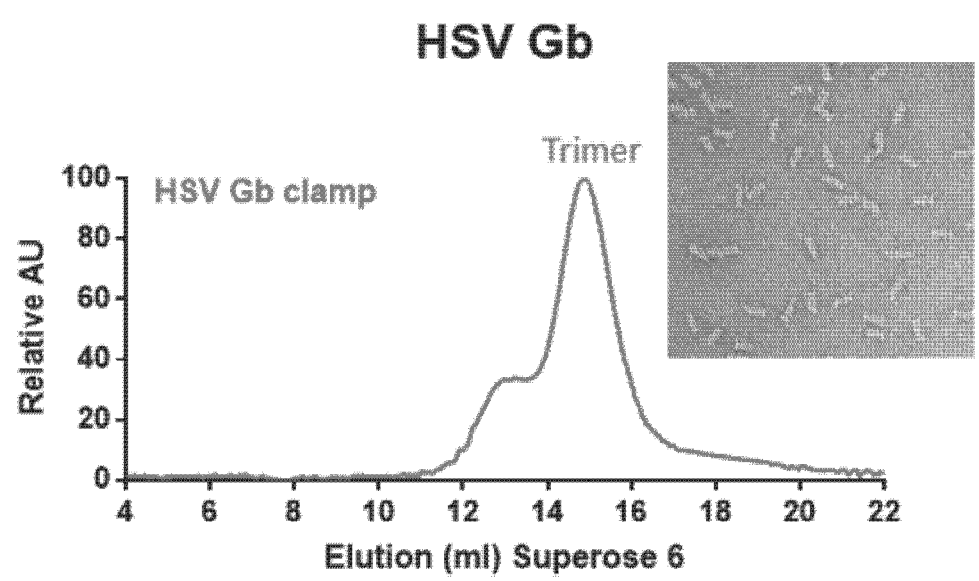
FIG. 21 is a graphical and photographic representation showing that inclusion of the molecular clamp facilitates stabilization of the trimeric structure of a class 3 viral fusion protein. Clamp-stabilized HSV2 Fusion glycoprotein B (gB) was analyzed by size exclusion chromatography. Elution volume on the superose 6 column correlates with the expected molecular weight of the soluble trimeric protein. Negative stain electron microscopy (inset) confirms the presence of homogenous, trimeric conformation similar to the published structure (Heldwein et al., *Science*, 2006. 313(5784): 217-20). This conformation has been shown to bind most neutralizing antibodies (Cairns et al., *JVi,* 2014. 88(5): 2677-2689).

To further validate the utility of the clamp SSM to the stabilization of viral fusion proteins, the clamp SSM was incorporated into the ectodomain of HSV2 gB and expressed in CHO cells. Protein purified by immunoaffinity chromatography was then analyzed by size exclusion chromatography on a superose 6 column. The major portion of the HSV2 gB clamp eluted at approximately 15 mL which is equivalent to roughly the expected size of the trimeric protein, ~300 kDa (FIG. 21). Purified HSV2 gB clamp was also analyzed by negative stain transmission electron microscopy (TEM) (FIG. 21, inset). Within the TEM image presented, it is clearly visible that particles of HSV2 gB clamp have a homogenous size and a topology consistent with the structure previously resolved by x-ray crystallography (Heldwein et al., Science, 2006. 313(5784): 217-20). This conformation is hypothesized to be the HSV2 gB post-fusion conformation. Notably, HSV2 gB clamp is also able to bind most neutralizing antibodies for HSV2 and may be useful as a subunit vaccine candidate (Cairns et al., JVi, 2014. 88(5): P. 2677-89). The data presented supports the ability of the clamp SSM to stabilize and purify viral Class III fusion proteins, in addition to viral Class I fusion proteins.

The results presented herein demonstrate that chimeric polypeptides that comprise an ectodomain of a viral fusion protein constrained in a pre-fusion conformation can:
- induce a more broadly cross-protective immune response;
- are stable at elevated temperatures;
- induce a superior neutralizing immune response; and
- form using Class I or Class III ectodomains.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

SEQUENCE LISTING (170 sequences)

SEQ ID NO: 1 - protein, 25 aa, Artificial Sequence
  heptad repeat region
IEEIQKQIAAIQKQIAAIQKQIYRM

SEQ ID NO: 2 - protein, 37 aa, Human immunodeficiency virus
SGIVQQQNNLLRAIEAQQHLLQLTVWGIKQLQARILA

SEQ ID NO: 3 - protein, 39 aa, Respiratory syncytial virus
LHLEGEVNKIKSALLSTNKAVVSLGNGVSVLTSKVLDLK

SEQ ID NO: 4 - protein, 39 aa, Human metapneumovirus
IRLESEVTAIKNALKKTNEAVSTLGNGVRVLATAVRELK

SEQ ID NO: 5 - protein, 39 aa, Parainfluenza virus
KQARSDIEKLKEAIRDTNKAVQSVQSSIGNLIVAIKSVQ

SEQ ID NO: 6 - protein, 39 aa, Measles virus
MLNSQAIDNLRASLETTNQAIEAIRQAGQEMILAVQGVQ

SEQ ID NO: 7 - protein, 39 aa, Hendra virus
MKNADNINKLKSSIESTNEAVVKLQETAEKTVYVLTALQ

SEQ ID NO: 8 - protein, 35 aa, Influenza A virus
ENGWEGMVDGWYGFRHQNSEGTGQAADLKSTQAAI

SEQ ID NO: 9 - protein, 34 aa, Influenza B virus
HGYTSHGAHGVAVAADLKSTQEAINKITKNLNYL

SEQ ID NO: 10 - protein, 37 aa, Ebola virus
GLRQLANETTQALQLFLRATTELRTFSILNRKAIDFL

SEQ ID NO: 11 - protein, 38 aa, Marburg virus
LANQTAKSLELLLRVTTEERTFSLINRHAIDFLLTRWG

SEQ ID NO: 12 - protein, 59 aa, Middle East Respiratory Syndrome virus
ISASIGDIIQRLDVLEQDAQIDRLINGRLTTLNAFVAQQLVRSESAALSAQLAKDKVNE

SEQ ID NO: 13 - protein, 59 aa, Severe Acute Respiratory Syndrome virus
ISSVLNDILSRLDKVEAEVQIDRLITGRLQSLQTYVTQQLIRAAEIRASANLAATKMSE

SEQ ID NO: 14 - protein, 38 aa, Human immunodeficiency virus
HTTWMEWDREINNYTSLIHSLIEESQNQQEKNEQELLE

SEQ ID NO: 15 - protein, 37 aa, respiratory syncytial virus
FDASISQVNEKINQSLAFIRKSDELLHNVNAGKSTTN

SEQ ID NO: 16 - protein, 35 aa, Human metapneumovirus
FNVALDQVFESIENSQALVDQSNRILSSAEKGNTG

SEQ ID NO: 17 - protein, 36 aa, Parainfluenza virus
IELNKAKSDLEESKEWIRRSNQKLDSIGNWHQSSTT

SEQ ID NO: 18 - protein, 40 aa, Measles virus
LERLDVGTNLGNAIAKLEDAKELLESSDQILRSMKGLSST

SEQ ID NO: 19 - protein, 32 aa, Hendra virus
ISSQISSMNQSLQQSKDYIKEAQKILDTVNPS

SEQ ID NO: 20 - protein, 49 aa, Influenza A virus
RIQDLEKYVEDTKIDLWSYNAELVLALENQHTIDLTDSEMSKLFERTRR

SEQ ID NO: 21 - protein, 52 aa, Influenza B virus
DEILELDEKVDDLRADTISSQIELAVLLSNEGIINSEDEHLLALERKLKKML

SEQ ID NO: 22 - protein, 23 aa, Ebola virus
HDWTKNITDKIDQIIHDFVDKTL

SEQ ID NO: 23 - protein, 17 aa, Marburg virus
IGIEDLSKNISEQIDQI

SEQ ID NO: 24 - protein, 44 aa, Middle East Respiratory Syndrome virus
NFGSLTQINTTLLDLTYEMLSLQQVVKALNESYIDLKELGNYTY

SEQ ID NO: 25 - protein, 43 aa, Severe Acute Respiratory Syndrome virus
DVDLGDISGINASVVNIQKEIDRLNEVAKNLNESLIDLQELGK

SEQ ID NO: 26 - protein, 25 aa, Artificial Sequence
  HR1 REGION SEQUENCE Synthetic
IEEIQKQIAAIQKQIAAIQKQIYRM

SEQ ID NO: 27 - protein, 25 aa, Artificial Sequence
  HR2 REGION SEQUENCE Synthetic
IEEIQKQIAAIQKQIAAIQKQIYRM

SEQ ID NO: 28 - protein, 37 aa, Human immunodeficiency virus; identical to SEQ ID NO: 2

SEQ ID NO: 29 - protein, 38 aa, Human immunodeficiency virus; identical to SEQ ID NO: 14

SEQ ID NO: 30 - protein, 39 aa, Respiratory syncytial virus; identical to SEQ ID NO: 3

SEQ ID NO: 31 - protein, 37 aa, Respiratory syncytial virus; identical to SEQ ID NO: 15

SEQ ID NO: 32 - protein, 39 aa, Human metapneumovirus; identical to SEQ ID NO: 4

SEQ ID NO: 33 - protein, 35 aa, Human metapneumovirus; identical to SEQ ID NO: 16

SEQ ID NO: 34 - protein, 39 aa, Parainfluenza virus; identical to SEQ ID NO: 5

SEQ ID NO: 35 - protein, 36 aa, Parainfluenza virus; identical to SEQ ID NO: 17

SEQ ID NO: 36 - protein, 39 aa, Measles virus; identical to SEQ ID NO: 6

SEQ ID NO: 37 - protein, 40 aa, Measles virus; identical to SEQ ID NO: 18

SEQ ID NO: 38 - protein, 39 aa, Hendra virus; identical to SEQ ID NO: 7

SEQ ID NO: 39 - protein, 32 aa, Hendra virus; identical to SEQ ID NO: 19

SEQ ID NO: 40 - protein, 35 aa, Influenza A virus; identical to SEQ ID NO: 8

SEQ ID NO: 41 - protein, 49 aa, Influenza A virus; identical to SEQ ID NO: 20

SEQ ID NO: 42 - protein, 34 aa, Influenza B virus; identical to SEQ ID NO: 9

SEQ ID NO: 43 - protein, 52 aa, Influenza B virus; identical to SEQ ID NO: 21

SEQ ID NO: 44 - protein, 37 aa, Ebola virus; identical to SEQ ID NO: 10

SEQ ID NO: 45 - protein, 23 aa, Ebola virus
HDWTKNITDKIDQIIHDFVDKTL

SEQ ID NO: 46 - protein, 37 aa, Marburg virus
LANQTAKSLELLLRVTTEERTFSLINRHAIDFLLTRW

SEQ ID NO: 47 - protein, 17 aa, Marburg virus
IGIEDLSKNISEQIDQI

SEQ ID NO: 48 - protein, 60 aa, Middle East Respiratory Syndrome virus
ISASIGDIIQRLDVLEQDAQIDRLINGRLTTLNAFVAQQLVRSESAALSAQLAKDKVNEG

SEQ ID NO: 49 - protein, 48 aa, Middle East Respiratory Syndrome virus
GSGGNFGSLTQINTTLLDLTYEMLSLQQVVKALNESYIDLKELGNYTY

SEQ ID NO: 50 - protein, 60 aa, Severe Acute Respiratory Syndrome virus
ISSVLNDILSRLDKVEAEVQIDRLITGRLQSLQTYVTQQLIRAAEIRASANLAATKMSEG

SEQ ID NO: 51 - protein, 47 aa, Severe Acute Respiratory Syndrome virus
GSGGDVDLGDISGINASVVNIQKEIDRLNEVAKNLNESLIDLQELGK

SEQ ID NO: 52 - protein, 566 aa, Influenza A virus
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 53 - protein, 529 aa, Influenza A virus
MKTIIAFSCILCLIFAQKLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKD

SEQ ID NO: 54 - protein, 512 aa, Influenza A virus
KLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKD

SEQ ID NO: 55 - protein, 452 aa, Artificial Sequence
  Ectodomain minus SP minus, MPER18 - 469
KLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRR

SEQ ID NO: 56 - protein, 514 aa, Artificial Sequence
  Ectodomain 18 - 341, 346 - 529 plus altered furin cleavage sites
KLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPERRRKKRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKD

SEQ ID NO: 57 - protein, 230 aa, Artificial Sequence
  Stem domain 1-58, 327-401, 442-509 plus linker regions
MKTIIALSYILCLVFAQKLPGNDNSTATLCLGHHAVPNGTIVKTITNDQIEVTNATELGFGQNTLKLATGMRNVPEKQTRGIFGAIAGFIENGWEGMLDGWYGFRHQNSEGRGQAADLKSTQAAIDQINGMLNRLIGSGGSGELLVALLNQHTIDLTDSEMNKLFEKTKKQLRENAEDMGNGCFKIYHKCDNACIGSIRNGTYDHDVYRDEALNNRFQIKGVELKSGYKD

SEQ ID NO: 58 - protein, 344 aa, Artificial Sequence
  Head domain 1-18, 51-328, 403-444 plus linker regions
MKTIIALSYILCLVFAQKEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNGSGGSGKTNEKFHQIEKEFSEVEGRIQDLEKYVEDTKIDLWSYNAELL

SEQ ID NO: 59 - protein, 584 aa, Influenza B virus
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 60 - protein, 547 aa, Influenza B virus
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHT

SEQ ID NO: 61 - protein, 531 aa, Influenza B virus
RICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHT

SEQ ID NO: 62 - protein, 471 aa, Artificial Sequence
  Ectodomain minus SP, minus MPER 17-487
RICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKML

SEQ ID NO: 63 - protein, 532 aa, Artificial Sequence
  Ectodomain minus SP plus altered furin cleavage sites 17-355, 362-547
RICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPARRRKKRAGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHT

SEQ ID NO: 64 - protein, 220 aa, Artificial Sequence
  Stem domain 1-47, 345-417, 457-547 plus linker regions
MKAIIVLLMVVTSNADRICTGITSSNSPHVVKTATQGEVNVTGVIPLGSGLANGTKYRPPAKLLKERGFFGAIAGFLEGGWEGMIAGWHGYTSHGAHGVAVAADLKSTQEAINKITKNLNYLSGSGGSGIELAVLLSNEGIINSEDEHLLALERKLKKMLGPSAVEIGNGCFETKHKCNQTCLDRIAAGTFNAGDFSLPTFDSLNITAASLNDDGLDNHT

SEQ ID NO: 65 - protein, 359 aa, Artificial Sequence
  Head domain 1-17, 48-344, 418-456 plus linker regions
MKAIIVLLMVVTSNADRTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKGSGGSGELEVKNLQRLSGAMNELHDEILELDEKVDDLRADTISSQ

SEQ ID NO: 66 - protein, 574 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 67 - protein, 524 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 68 - protein, 501 aa, respiratory syncytial virus
SGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 69 - protein, 501 aa, Artificial Sequence
  Ectodomain minus SP plus altered furin cleavage sites 24-524
SGQNITEEFYQSTCSAVSKGYLSALRTGWYTSVITIELSNIKKNKCNGTDAKVKLIKQELDKYKNAVTELQLLMQSTQATNNNANNELPRFMNYTLNNAKKTNVTLSNNNNNNFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 70 - protein, 87 aa, Artificial Sequence
  D25 interaction domain 61-97, 193-240 plus linker regions
LSNIKKNKCNGTDAKVKLIKQELDKYKNAVTELQLLMGGLDLKNYIDKQLLPIVNKQSCSISNIETVIEFQQKNNRLLEITREFSVN

SEQ ID NO: 71 - protein, 539 aa, Human metapneumovirus
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 72 - protein, 490 aa, Human metapneumovirus
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTG

SEQ ID NO: 73 - protein, 471 aa, Human metapneumovirus
KESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTG

SEQ ID NO: 74 - protein, 471 aa, Artificial Sequence
  Ectodomain minus SP plus altered furin cleavage sites 20-490
KESYLEESCSTITEGYLSVLRTGWYTNVFTLEVGDVENLTCADGPSLIKTELDLTKSALRELRTVSADQLAREEQIENPNQSNFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTG

SEQ ID NO: 75 - protein, 539 aa, Parainfluenza virus
MPTSILLIITTMIMASFCQIDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTVVTSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTTIIIVLIMIIILFIINVTIIIIAVKYYRIQKRNRVDQNDKPYVLTNK

SEQ ID NO: 76 - protein, 493 aa, Parainfluenza virus
MPTSILLIITTMIMASFCQIDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTVVTSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTT

SEQ ID NO: 77 - protein, 474 aa, Parainfluenza virus
IDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTVVTSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTT

SEQ ID NO: 78 - protein, 474 aa, Artificial Sequence
  Ectodomain minus SP plus altered furin cleavage sites 20-493
IDITKLQHVGVLVNSPKGMKISQNFETRYLILSLIPKIEDSNSCGDQQIKQYKRLLDRLIIPLYDGLRLQKDVIVSNQESNENTDPNTKNFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTVVTSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTT

SEQ ID NO: 79 - protein, 550 aa, Measles virus
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL

SEQ ID NO: 80 - protein, 493 aa, Measles virus
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSST

SEQ ID NO: 81 - protein, 469 aa, Measles virus
IHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSST

SEQ ID NO: 82 - protein, 469 aa, Artificial Sequence
  Ectodomain minus SP plus altered furin cleavage sites
IHWGNLSKIGVVGIGSASYKVMTRSSHQSLVIKLMPNITLLNNCTRVEIAEYRRLLRTVLEPIRDALNAMTQNIRPVQSVASSNNHKNFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSST

SEQ ID NO: 83 - protein, 546 aa, Hendra virus
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 84 - protein, 487 aa, Hendra virus
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPS

SEQ ID NO: 85 - protein, 467 aa, Hendra virus
SLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPS

SEQ ID NO: 86 - protein, 467 aa, Artificial Sequence
  Ectodomain minus SP plus altered furin cleavage sites 21-487
SLEGLGILHYEKLSKIGLVKGITRKYKIKSNPLTKDIVIKMIPNVSNVSKCTGTVMENYKSRLTGILSPIKGAIELYNNNTHDLVGDVNLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPS

SEQ ID NO: 87 - protein, 546 aa, Nipah virus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 88 - protein, 487 aa, Nipah virus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPS

SEQ ID NO: 89 - protein, 467 aa, Nipah virus
SECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPS

SEQ ID NO: 90 - protein, 467 aa, Artificial Sequence
  Ectodomain minus SP plus altered furin cleavage sites
SECSVGILHYEKLSKIGLVKGVTRKYKIKSNPLTKDIVIKMIPNVSNMSQCTGSVMENYKTRLNGILTPIKGALEIYKNNTHDLVGDVNLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPS

SEQ ID NO: 91 - protein, 861 aa, Human immunodeficiency virus
MRVKGTRKNYWWRWGTMLLGMLMICSAAEQLWVTVYYGVPVWKEATTTLFCASDAKAVNTEVHNVWATHACVPTDPNPQEVVLENVTENFNMWKNDMVEQMQEDIISLWDQSLKPCVKLTPLCVTLNCTNWDGRNGTMNTTSTRNTTTANISRWEMEGEIKNCSFNVTTSIRNKMHKEYALFYKLDVMPIDNGSSYTLINCNTSVITQACPKVSFEPIPIHYCTPAGFALLKCNDKKFNGTGPCKNVSTVQCTHGIRPVVSTQLLLNGSLAEEEIVIRSENLTDNAKTIIVQLNETVVINCTRPGNNTRKSIHIGPGRAFYATGDIIGDIRQAHCNLSEASWNKTLKQIATKLREQFVNKTIIFNQSSGGDPEIVMHSFNCGGEFFYCDTTQLFNSAWFSNNTGLNYNNGSNTGGNITLPCRIKQIVNRWQEVGKAMYAPPIRGNITCSSNITGLLLTRDGGNNVTNESEIFRPGGGNMKDNWRSELYKYKVVKIEPLGVAPTRAKRRVVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQLDTWASLWNWFSISNWLWYIKIFIMIVAGLVGLRIFFAVLSIVNRVRQGYSPLSFQTHLPAQRGPDRPGGIEEEGGERDNGRSIRLVDGFLALIWDDLRSLCLFSYHRLRDLLLLVKRVVELLGHRGWEILKYWWNLLQYWSQELKNSAVSLFNAIAIAVAEGTDRVIEGIQRIGRGFLHIPRRIRQGLERALL

SEQ ID NO: 92 - protein, 688 aa, Human immunodeficiency virus
MRVKGTRKNYWWRWGTMLLGMLMICSAAEQLWVTVYYGVPVWKEATTTLFCASDAKAVNTEVHNVWATHACVPTDPNPQEVVLENVTENFNMWKNDMVEQMQEDIISLWDQSLKPCVKLTPLCVTLNCTNWDGRNGTMNTTSTRNTTTANISRWEMEGEIKNCSFNVTTSIRNKMHKEYALFYKLDVMPIDNGSSYTLINCNTSVITQACPKVSFEPIPIHYCTPAGFALLKCNDKKFNGTGPCKNVSTVQCTHGIRPVVSTQLLLNGSLAEEEIVIRSENLTDNAKTIIVQLNETVVINCTRPGNNTRKSIHIGPGRAFYATGDIIGDIRQAHCNLSEASWNKTLKQIATKLREQFVNKTIIFNQSSGGDPEIVMHSFNCGGEFFYCDTTQLFNSAWFSNNTGLNYNNGSNTGGNITLPCRIKQIVNRWQEVGKAMYAPPIRGNITCSSNITGLLLTRDGGNNVTNESEIFRPGGGNMKDNWRSELYKYKVVKIEPLGVAPTRAKRRVVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQLDTWASLWNWFSISNWLWYIK

SEQ ID NO: 93 - protein, 660 aa, Human immunodeficiency virus
EQLWVTVYYGVPVWKEATTTLFCASDAKAVNTEVHNVWATHACVPTDPNPQEVVLENVTENFNMWKNDMVEQMQEDIISLWDQSLKPCVKLTPLCVTLNCTNWDGRNGTMNTTSTRNTTTANISRWEMEGEIKNCSFNVTTSIRNKMHKEYALFYKLDVMPIDNGSSYTLINCNTSVITQACPKVSFEPIPIHYCTPAGFALLKCNDKKFNGTGPCKNVSTVQCTHGIRPVVSTQLLLNGSLAEEEIVIRSENLTDNAKTIIVQLNETVVINCTRPGNNTRKSIHIGPGRAFYATGDIIGDIRQAHCNLSEASWNKTLKQIATKLREQFVNKTIIFNQSSGGDPEIVMHSFNCGGEFFYCDTTQLFNSAWFSNNTGLNYNNGSNTGGNITLPCRIKQIVNRWQEVGKAMYAPPIRGNITCSSNITGLLLTRDGGNNVTNESEIFRPGGGNMKDNWRSELYKYKVVKIEPLGVAPTRAKRRVVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQLDTWASLWNWFSISNWLWYIK

SEQ ID NO: 94 - protein, 639 aa, Artificial Sequence
  Ectodomain minus SP, minus MPER
EQLWVTVYYGVPVWKEATTTLFCASDAKAVNTEVHNVWATHACVPTDPNPQEVVLENVTENFNMWKNDMVEQMQEDIISLWDQSLKPCVKLTPLCVTLNCTNWDGRNGTMNTTSTRNTTTANISRWEMEGEIKNCSFNVTTSIRNKMHKEYALFYKLDVMPIDNGSSYTLINCNTSVITQACPKVSFEPIPIHYCTPAGFALLKCNDKKFNGTGPCKNVSTVQCTHGIRPVVSTQLLLNGSLAEEEIVIRSENLTDNAKTIIVQLNETVVINCTRPGNNTRKSIHIGPGRAFYATGDIIGDIRQAHCNLSEASWNKTLKQIATKLREQFVNKTIIFNQSSGGDPEIVMHSFNCGGEFFYCDTTQLFNSAWFSNNTGLNYNNGSNTGGNITLPCRIKQIVNRWQEVGKAMYAPPIRGNITCSSNITGLLLTRDGGNNVTNESEIFRPGGGNMKDNWRSELYKYKVVKIEPLGVAPTRAKRRVVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQ

SEQ ID NO: 95 - protein, 660 aa, Artificial Sequence
  Ectodomain minus SP plus altered furin cleavage sites
EQLWVTVYYGVPVWKEATTTLFCASDAKAVNTEVHNVWATHACVPTDPNPQEVVLENVTENFNMWKNDMVEQMQEDIISLWDQSLKPCVKLTPLCVTLNCTNWDGRNGTMNTTSTRNTTTANISRWEMEGEIKNCSFNVTTSIRNKMHKEYALFYKLDVMPIDNGSSYTLINCNTSVITQACPKVSFEPIPIHYCTPAGFALLKCNDKKFNGTGPCKNVSTVQCTHGIRPVVSTQLLLNGSLAEEEIVIRSENLTDNAKTIIVQLNETVVINCTRPGNNTRKSIHIGPGRAFYATGDIIGDIRQAHCNLSEASWNKTLKQIATKLREQFVNKTIIFNQSSGGDPEIVMHSFNCGGEFFYCDTTQLFNSAWFSNNTGLNYNNGSNTGGNITLPCRIKQIVNRWQEVGKAMYAPPIRGNITCSSNITGLLLTRDGGNNVTNESEIFRPGGGNMKDNWRSELYKYKVVKIEPLGVAPTNANNNVVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQLDTWASLWNWFSISNWLWYIK

SEQ ID NO: 96 - protein, 180 aa, Artificial Sequence
  GP41 ectodomain 509-688
VVQREKRAVGTIGAMFLGFLGAAGSTMGAASLTLTVQARQLLSGIVQQQNNLLRAIEAQQHLLQLTVWGIKQLQARVLAVERYLKDQQLLGIWGCSGRLICTTAVPWNASWSNKSLDDIWNNMTWMQWEKEIDNYTGLIYRLIEESQTQQEKNEQDLLQLDTWASLWNWFSISNWLWYIK

SEQ ID NO: 97 - protein, 676 aa, Ebola virus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 98 - protein, 650 aa, Ebola virus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQ

SEQ ID NO: 99 - protein, 623 aa, Ebola virus
QRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQ

SEQ ID NO: 100 - protein, 608 aa, Artificial Sequence
  Ectodomain minus SP, minus MPER
QRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTL

SEQ ID NO: 101 - protein, 608 aa, Artificial Sequence
  Ectodomain minus SP plus altered furin cleavage sites
QRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGNNTNNEAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTL

SEQ ID NO: 102 - protein, 475 aa, Artificial Sequence
  Ectodomain minus SP, minus mucin-like domain
QRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQ

SEQ ID NO: 103 - protein, 681 aa, Marburg virus
MKTTCFLISLILIQGTKNLPILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLTSTPTDATKLNTTDPSSDDEDLATSGSGSGEREPHTTSDAVTKQGLSSTMPPTPSPQPSTPQQGGNNTNHSQDAVTELDKNNTTAQPSMPPHNTTTISTNNTSKHNFSTLSAPLQNTTNDNTQSTITENEQTSAPSITTLPPTGNPTTAKSTSSKKGPATTAPNTTNEHFTSPPPTPSSTAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWGVLTNLGILLLLSIAVLIALSCICRIFTKYIG

SEQ ID NO: 104 - protein, 650 aa, Marburg virus
MKTTCFLISLILIQGTKNLPILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLTSTPTDATKLNTTDPSSDDEDLATSGSGSGEREPHTTSDAVTKQGLSSTMPPTPSPQPSTPQQGGNNTNHSQDAVTELDKNNTTAQPSMPPHNTTTISTNNTSKHNFSTLSAPLQNTTNDNTQSTITENEQTSAPSITTLPPTGNPTTAKSTSSKKGPATTAPNTTNEHFTSPPPTPSSTAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWG

SEQ ID NO: 105 - protein, 631 aa, Marburg virus
PILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLTSTPTDATKLNTTDPSSDDEDLATSGSGSGEREPHTTSDAVTKQGLSSTMPPTPSPQPSTPQQGGNNTNHSQDAVTELDKNNTTAQPSMPPHNTTTISTNNTSKHNFSTLSAPLQNTTNDNTQSTITENEQTSAPSITTLPPTGNPTTAKSTSSKKGPATTAPNTTNEHFTSPPPTPSSTAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWG

SEQ ID NO: 106 - protein, 608 aa, Artificial Sequence
  Ectodomain minus SP, minus MPER 20-627
PILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLTSTPTDATKLNTTDPSSDDEDLATSGSGSGEREPHTTSDAVTKQGLSSTMPPTPSPQPSTPQQGGNNTNHSQDAVTELDKNNTTAQPSMPPHNTTTISTNNTSKHNFSTLSAPLQNTTNDNTQSTITENEQTSAPSITTLPPTGNPTTAKSTSSKKGPATTAPNTTNEHFTSPPPTPSSTAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQI

SEQ ID NO: 107 - protein, 631 aa, Artificial Sequence
  Ectodomain minus SP plus altered furin cleavage sites
PILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLTSTPTDATKLNTTDPSSDDEDLATSGSGSGEREPHTTSDAVTKQGLSSTMPPTPSPQPSTPQQGGNNTNHSQDAVTELDKNNTTAQPSMPPHNTTTISTNNTSKHNFSTLSAPLQNTTNDNTQSTITENEQTSAPSITTLPPTGNPTTAKSTSSKKGPATTAPNTTNEHFTSPPPTPSSTAQHLVYFNNNNSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWG

SEQ ID NO: 108 - protein, 453 aa, Artificial Sequence
  Ectodomain minus SP, minus mucin-like domain
PILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLGGAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWG

SEQ ID NO: 109 - protein, 1255 aa, Severe Acute Respiratory Syndrome virus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTNVSAAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKGELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 110 - protein, 1199 aa, Severe Acute Respiratory Syndrome virus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTNVSAAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKGELDKYFKNHTSPDVDLGDISGINASVVNIQKEIDRLNEVAKNLNESLIDLQELGKYEQYIKWPWYVW

SEQ ID NO: 111 - protein, 1186 aa, Severe Acute Respiratory Syndrome virus
SDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTNVSAAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKGELDKYFKNHTSPDVDLGDISGINASVVNIQKEIDRLNEVAKNLNESLIDLQELGKYEQYIKWPWYVW

SEQ ID NO: 112 - protein, 1174 aa, Artificial Sequence
  Ectodomain minus SP, minus MPER
SDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTNVSAAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKGELDKYFKNHTSPDVDLGDISGINASVVNIQKEIDRLNEVAKNLNESLIDLQELGK

SEQ ID NO: 113 - protein, 1353 aa, Middle East Respiratory Syndrome virus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 114 - protein, 1301 aa, Middle East Respiratory Syndrome virus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWL

SEQ ID NO: 115 - protein, 1280 aa, Middle East Respiratory Syndrome virus
GPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWL

SEQ ID NO: 116 - protein, 1270 aa, Artificial Sequence
  Ectodomain minus SP, minus MPER 22-1291
GPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTY

SEQ ID NO: 117 - protein, 1280 aa, Artificial Sequence
  Ectodomain minus SP plus altered furin cleavage sites
GPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPNSVNSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSNSANSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWL

SEQ ID NO: 118 - protein, 510 aa, Vesicular stomatitis virus
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLG

SEQ ID NO: 119 - protein, 462 aa, Vesicular stomatitis virus
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWK

SEQ ID NO: 120 - protein, 445 aa, Vesicular stomatitis virus
FTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWK

SEQ ID NO: 121 - protein, 404 aa, Artificial Sequence
  Ectodomain minus SP, minus MPER
FTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVF

SEQ ID NO: 122 - protein, 524 aa, Rabies virus
MIPQTLLFVPLLVFSLCFGKFPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVSDLDPYDKSLHSRVFPSGKCSGITVSSTYCPTNHDYTIWMPENPRLGTSCDIFTNSRGKRASKGSKTCGFVDERGLYKSLKGACKLKLCGVLGLRLMDGTWAAIQTSDEAKWCPPDQLVNIHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPSWGKYVLMSVGTLIALMLMILLTTCCRKANGAESIQHRLGETGRKVSVTSQNGRVISSWESYKSGGETKL

SEQ ID NO: 123 - protein, 458 aa, Rabies virus
MIPQTLLFVPLLVFSLCFGKFPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVSDLDPYDKSLHSRVFPSGKCSGITVSSTYCPTNHDYTIWMPENPRLGTSCDIFTNSRGKRASKGSKTCGFVDERGLYKSLKGACKLKLCGVLGLRLMDGTWAAIQTSDEAKWCPPDQLVNIHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPSWGK

SEQ ID NO: 124 - protein, 438 aa, Rabies virus
FPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVSDLDPYDKSLHSRVFPSGKCSGITVSSTYCPTNHDYTIWMPENPRLGTSCDIFTNSRGKRASKGSKTCGFVDERGLYKSLKGACKLKLCGVLGLRLMDGTWAAIQTSDEAKWCPPDQLVNIHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPSWGK

SEQ ID NO: 125 - protein, 904 aa, Herpes simplex virus type I
MRQGAPARGCRWFVVWALLGLTLGVLVASAAPSSPGTPGVAAATQAANGGPATPAPPALGAAPTGDPKPKKNKKPKNPTPPRPAGDNATVAAGHATLREHLRDIKAESTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNPFGALAVGLLVLAGLAAAFFAFRYVMRLQSNPMKALYPLTTKELKNPTNPDASGEGEEGGDFDEAKLAEAREMIRYMALVSAMEHTEHKAKKKGTSALLSAKVTDMVMRKRRNTNYTQVPNKDGDADEDDL

SEQ ID NO: 126 - protein, 774 aa, Herpes simplex virus type I
MRQGAPARGCRWFVVWALLGLTLGVLVASAAPSSPGTPGVAAATQAANGGPATPAPPALGAAPTGDPKPKKNKKPKNPTPPRPAGDNATVAAGHATLREHLRDIKAESTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNP

SEQ ID NO: 127 - protein, 750 aa, Herpes simplex virus type I
VLVASAAPSSPGTPGVAAATQAANGGPATPAPPALGAAPTGDPKPKKNKKPKNPTPPRPAGDNATVAAGHATLREHLRDIKAESTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNP

SEQ ID NO: 128 - protein, 611 aa, Artificial Sequence
  Inf A HA ectodomain - HIV GP160-based SSM
MKTIIAFSCILCLIFAQKLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDGGSGIVQQQNNLLRAIEAQQHLLQLTVWGIKQLQARILAGGSGGHTTWMEWDREINNYTSLIHSLIEESQNQQEKNEQELLE

SEQ ID NO: 129 - protein, 313 aa, Artificial Sequence
  Inf A HA stem domain - HIV GP160-based SSM
MKTIIALSYILCLVFAQKLPGNDNSTATLCLGHHAVPNGTIVKTITNDQIEVTNATELGFGQNTLKLATGMRNVPEKQTRGIFGAIAGFIENGWEGMLDGWYGFRHQNSEGRGQAADLKSTQAAIDQINGMLNRLIGSGGSGELLVALLNQHTIDLTDSEMNKLFEKTKKQLRENAEDMGNGCFKIYHKCDNACIGSIRNGTYDHDVYRDEALNNRFQIKGVELKSGYKDGGRSGIVQQQNNLLRAIEAQQHLLQLTVWGIKQLQARILAGGSGGHTTWMEWDREINNYTSLIHSLIEESQNQQEKNEQELLE

SEQ ID NO: 130 - protein, 612 aa, Artificial Sequence
  Inf A H5 ectodomain - HIV GP160-based SSM
MGWSCIILFLVATATGVHSEDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILRPNDAINFESNGNFIAPEYAYKIVKKGDSTIMKSELEYGNCNAKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGSGIVQQQNNLLRAIEAQQHLLQLTVWGIKQLQARILAGGSGGHTTWMEWDREINNYTSLIHSLIEESQNQPAKDEQELLE

SEQ ID NO: 131 - protein, 629 aa, Artificial Sequence
  Inf B HA ectodomain - HIV GP160-based SSM
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTGGSGIVQQQNNLLRAIEAQQHLLQLTVWGIKQLQARILAGGSGGHTTWMEWDREINNYTSLIHSLIEESQNQQEKNEQELLE

SEQ ID NO: 132 - protein, 606 aa, Artificial Sequence
  RSV F ectodomain - HIV GP160-based SSM
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNGGSGIVQQQNNLLRAIEAQQHLLQLTVWGIKQLQARILAGGSGGHTTWMEWDREINNYTSLIHSLIEESQNQQEKNEQELLE

SEQ ID NO: 133 - protein, 571 aa, Artificial Sequence
  hMPV F ectodomain - HIV GP160-based SSM
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGGSGIVQQQNNLLRAIEAQQHLLQLTVWGIKQLQARILAGGSGGHTTWMEWDREINNYTSLIHSLIEESQNQQEKNEQELLE

SEQ ID NO: 134 - protein, 575 aa, Artificial Sequence
  PIV F ectodomain - HIV GP160-based SSM
MPTSILLIITTMIMASFCQIDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTVVTSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTTGGSGIVQQQNNLLRAIEAQQHLLQLTVWGIKQLQARILAGGSGGHTTWMEWDREINNYTSLIHSLIEESQNQQEKNEQELLE

SEQ ID NO: 135 - protein, 575 aa, Artificial Sequence
  MeV F ectodomain - HIV GP160-based SSM
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSSTGGSGIVQQQNNLLRAIEAQQHLLQLTVWGIKQLQARILAGGSGGHTTWMEWDREINNYTSLIHSLIEESQNQQEKNEQELLE

SEQ ID NO: 136 - protein, 569 aa, Artificial Sequence
  HeV F ectodomain - HIV GP160-based SSM
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSGGSGIVQQQNNLLRAIEAQQHLLQLTVWGIKQLQARILAGGSGGHTTWMEWDREINNYTSLIHSLIEESQNQQEKNEQELLE

SEQ ID NO: 137 - protein, 569 aa, Artificial Sequence
  NiV F ectodomain - HIV GP160-based SSM
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSGGSGIVQQQNNLLRAIEAQQHLLQLTVWGIKQLQARILAGGSGGHTTWMEWDREINNYTSLIHSLIEESQNQQEKNEQELLE

SEQ ID NO: 138 - protein, 753 aa, Artificial Sequence
  HIV GP160 ectodomain - RSV F-based SSM
MRVMGIERNYPCWWTWGIMILGMIIICNTAENLWVTVYYGVPIWKDANTTLFCASDAKAYDTEVHNVWATHACVPTDPSPQELKMENVTEEFNMWKNNMVEQMHTDIISLWDQSLKPCVQLTPLCVTLDCSYNITNNITNSITNSSVNMREEIKNCSFNMTTELRDKNRKVYSLFYKLDVVQINNGNNSSNLYRLINCNTSALTQACPKVTFEPIPIHYCAPAGYAILKCNDKEFNGTGLCKNVSTVQYTHGIRPVVSTQLLLNGSLAEGKVMIRSENITNNVKNIIVQLNESVTINCTRPNNNTRRSVRIGPGQTFYATGDIIGDIRQAHCNVSGSQWNKTLHQVVEQLRKYWNNNTIIFNSSSGGDLEITTHSFNCAGEFFYCNTSGLFNSTWVNGTTSSMSNGTITLPCRIKQIINMWQRVGQAMYAPPIQGVIKCESNITGLILTRDGGVNSSDSETFRPGGGDMRDNWRSELYKYKVVKIEPLGVAPTKARRRVVEREKRAVTLGAVFIGFLGTAGSTMGAVSITLTVQARKLLSGIVQQQSNLLRAIEAQQHLLKLTVWGIKQLQARVLAVERYLRDQQLLGIWGCSGKLICPTNVPWNSSWSNKSLDEIWENMTWLQWDKEISNYTIKIYELIEESQIQQERNEKDLLELDKWASLWNWFDISKWLWYIKGGGVNKIKSALLSTNKAVVSLSNGVSVLTSKVLDLKGGGGHHHHGGGFDASISQVNEKINQSLAFIRKSDELLHNV

SEQ ID NO: 139 - protein, 584 aa, Artificial Sequence
  EBOV GP ectodomain, minus mucin like domain (1-311,462-650)- HIV GP160-based SSM
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQGGSGIVQQQNNLLRAIEAQQHLLQLTVWGIKQLQARILAGGSGGHTTWMEWDREINNYTSLIHSLIEESQNQQEKNEQELLE

SEQ ID NO: 140 - protein, 553 aa, Artificial Sequence
  MARV GP ectodomain, minus mucin like domain - HIV GP160-based SSM
MKTTCFLISLILIQGTKNLPILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGALQEYNSTKNQTCAPSKIPPPLPTARPEIKLGGAQHLVYFRRKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAVLIKNQNNLVCRLRRLANQTAKSLELLLRVTTEERTFSLINRHAIDFLLTRWGGTCKVLGPDCCIGIEDLSKNISEQIDQIKKDEQKEGTGWGLGGKWWTSDWGGSGIVQQQNNLLRAIEAQQHLLQLTVWGIKQLQARILAGGSGGHTTWMEWDREINNYTSLIHSLIEESQNQQEKNEQELLE

SEQ ID NO: 141 - protein, 1281 aa, Artificial Sequence
  SARS-CoV S ectodomain - HIV GP160-based SSM
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTNVSAAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKGELDKYFKNHTSPDVDLGDISGINASVVNIQKEIDRLNEVAKNLNESLIDLQELGKYEQYIKWPWYVWGGSGIVQQQNNLLRAIEAQQHLLQLTVWGIKQLQARILAGGSGGHTTWMEWDREINNYTSLIHSLIEESQNQQEKNEQELLE

SEQ ID NO: 142 - protein, 1383 aa, Artificial Sequence
  MERS-CoV S ectodomain - HIV GP160-based SSM
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGGSGIVQQQNNLLRAIEAQQHLLQLTVWGIKQLQARILAGGSGGHTTWMEWDREINNYTSLIHSLIEESQNQQEKNEQELLE

SEQ ID NO: 143 - protein, 544 aa, Artificial Sequence
  VSV G ectodomain - HIV GP160-based SSM
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKGGSGIVQQQNNLLRAIEAQQHLLQLTVWGIKQLQARILAGGSGGHTTWMEWDREINNYTSLIHSLIEESQNQQEKNEQELLE

SEQ ID NO: 144 - protein, 540 aa, Artificial Sequence
  RABV GP ectodomain - HIV GP160-based SSM
MIPQTLLFVPLLVFSLCFGKFPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVSDLDPYDKSLHSRVFPSGKCSGITVSSTYCPTNHDYTIWMPENPRLGTSCDIFTNSRGKRASKGSKTCGFVDERGLYKSLKGACKLKLCGVLGLRLMDGTWAAIQTSDEAKWCPPDQLVNIHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPSWGKGGSGIVQQQNNLLRAIEAQQHLLQLTVWGIKQLQARILAGGSGGHTTWMEWDREINNYTSLIHSLIEESQNQQEKNEQELLE

SEQ ID NO: 145 - protein, 856 aa, Artificial Sequence
  HSV1 Gb ectodomain - HIV GP160-based SSM
MRQGAPARGRRWFVVWALLGLTLGVLVVSAAPSSPGTPGVAAATQAANGGPATPAPPAPGAPPTGDPKPKKNKKPKPPKPPRPAGDNATVAAGHATLREHLRDIKAENTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNPGGSGIVQQQNNLLRAIEAQQHLLQLTVWGIKQLQARILAGGSGGHTTWMEWDREINNYTSLIHSLIEESQNQQEKNEQELLE

SEQ ID NO: 146 - protein, 520 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGK

SEQ ID NO: 147 - protein, 600 aa, Artificial Sequence
  Ectodomain of RSV F (1-520) - HIV GP160-based SSM
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCEIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSGIVQQQNNLLRAIEAQQHLLQLTVWGIKQLQARILAGGSGGHTTWMEWDREINNYTSLIHSLIEESQNQPAKDEQELLE

SEQ ID NO: 148 - protein, 529 aa, Influenza A virus
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGESSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKD

SEQ ID NO: 149 - protein, 610 aa, Artificial Sequence
  Ectodomain of INFA HA (1-529) - HIV GP160-based SSM
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGESSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDGSGIVQQQNNLLRAIEAQQHLLQLTVWGIKQLQARILAGGSGGHTTWMEWDREINNYTSLIHSLIEESQNQPAKDEQELLE

SEQ ID NO: 150 - protein, 600 aa, Artificial Sequence
  Ectodomain of RSV F (1-520) - DScav mutations - HIV GP160-based SSM
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSGIVQQQNNLLRAIEAQQHLLQLTVWGIKQLQARILAGGSGGHTTWMEWDREINNYTSLIHSLIEESQNQPAKDEQELLE

SEQ ID NO: 151 - protein, 563 aa, Artificial Sequence
  Ectodomain of RSV F (1-513) - DScav mutations -Foldon SSM
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSGSAWSHPQFEK

SEQ ID NO: 152 - protein, 1378 aa, Artificial Sequence
  Ectodomain of MERS Spike (1-1296) - HIV GP160-based SSM
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPGGSGIVQQQNNLLRAIEAQQHLLQLTVWGIKQLQARILAGGSGGHTTWMEWDREINNYTSLIHSLIEESQNQQEKNEQELLE

SEQ ID NO: 153 - protein, 583 aa, Artificial Sequence
  EBOV GP ectodomain, minus mucin like domain (1-311,462-650)- HIV GP160-based SSM + G1
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQGGSGIVQQQNNLLRAIEAQQHLLQLTVWGIKQLQARILAGGSGGTTWMNWTREINNYTSLIHSLIEESQNQQEKNEQELLE

SEQ ID NO: 154 - protein, 468 aa, Artificial Sequence
  Ectodomain minus mucin-like domain
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTL

SEQ ID NO: 155 - protein, 583 aa, Artificial Sequence
  EBOV GP ectodomain, minus mucin like domain (1-311,462-650)- HIV GP160-based SSM + G3
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQGGSGIVQQQNNLLRAIEAQQHLLQLTVWGIKQLQARILAGGSGGTTWMEWDREINNYTSLIHSLIEESQNQTEKNEQELLE

SEQ ID NO: 156 - protein, 583 aa, Artificial Sequence
  EBOV GP ectodomain, minus mucin like domain (1-311,462-650)- HIV GP160-based SSM + G4
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQGGSGIVQQQNNLLRAIEAQQHLLQLTVWGIKQLQARILAGGSGGTTWMEWDREINNYTSLIHSLIEESQNQQEKNENETLE

SEQ ID NO: 157 - protein, 533 aa, Influenza A virus
MGWSCIILFLVATATGVHSEQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKD

SEQ ID NO: 158 - protein, 585 aa, Artificial Sequence
  Ectodomain of Influenza HA (A Switzerland 2013, H3N2) (1-533) - Foldon SSM
MGWSCIILFLVATATGVHSEQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDGGSAIGGYIPEAPRDGQAYVRKDGEWVLLSTFLGGLVPRGSGSAWSHPQFEK

SEQ ID NO: 159 - protein, 614 aa, Artificial Sequence
  Ectodomain of Influenza HA (A Switzerland 2013 H3N2) (1-533) - HIV GP160-based SSM
MGWSCIILFLVATATGVHSEQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDGSGIVQQQNNLLRAIEAQQHLLQLTVWGIKQLQARILAGGSGGHTTWMEWDREINNYTSLIHSLIEESQNQPAKDEQELLE

SEQ ID NO: 160 - protein, 526 aa, Influenza A virus
MKVKLLVLLCTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTR

SEQ ID NO: 161 - protein, 578 aa, Artificial Sequence
  Ectodomain of Influenza HA (A California 2009, H1N1pdm) (1-526) - Foldon SSM
MKVKLLVLLCTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRGGSAIGGYIPEAPRDGQAYVRKDGEWVLLSTFLGGLVPRGSGSAWSHPQFEK

SEQ ID NO: 162 - protein, 608 aa, Artificial Sequence
  Ectodomain of Influenza HA (A California 2009, H1N1pdm) (1-526) - HIV GP160-based SSM
MMKVKLLVLLCTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRGSGIVQQQNNLLRAIEAQQHLLQLTVWGIKQLQARILAGGSGGHTTWMEWDREINNYTSLIHSLIEESQNQPAKDEQELLE

SEQ ID NO: 163 - protein, 526 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVGGGGHHHHHH

SEQ ID NO: 164 - protein, 563 aa, Artificial Sequence; identical to SEQ ID NO: 151
  Ectodomain of RSV F (1-513) - DScav mutations -Foldon SSM

SEQ ID NO: 165 - protein, 555 aa, Artificial Sequence
  Ectodomain of RSV F (1-105,145-511) - HIV GP160-based SSM
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNGSGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGSGIVQQQNNLLRAIEAQQHLLQLTVWGIKQLQARILAGGSGGHTTWMEWDREINNYTSLIHSLIEESQNQQEKNEQELLE

SEQ ID NO: 166 - protein, 564 aa, Artificial Sequence
  Ectodomain of Nipah F (1-483) - HIV GP160-based SSM
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTGSGIVQQQNNLLRAIEAQQHLLQLTVWGIKQLQARILAGGSGGHTTWMEWDREINNYTSLIHSLIEESQNQQEKNEQELLE

SEQ ID NO: 167 - protein, 818 aa, Artificial Sequence
  Ectodomain of HSV1 gB (28-741) - IgK signal peptide - HIV GP160-based SSM
MGWSCIILFLVATATGVHSERASGDVAATVAANGGPASQPPPVPSPATTKARKRKTKKPPKRPEATPPPDANATVAAGHATLRAHLREIKVENADAQFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNMETTAFHRDDHETDMELKPAKVATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATSPTTRNLLTTPKFTVAWDWVPKRPAVCTMTKWQEVDEMLRAEYGGSFRFSSDAISTTFTTNLTQYSLSRVDLGDCIGRDAREAIDRMFARKYNATHIKVGQPQYYLATGGFLIAYQPLLSNTLAELYVREYMREQDRKPRNATPAPLREAPSANASVERIKTTSSIEFARLQFTYNHIQRHVNDMLGRIAVAWCELQNHELTLWNEARKLNPNAIASATVGRRVSARMLGDVMAVSTCVPVAPDNVIVQNSMRVSSRPGTCYSRPLVSFRYEDQGPLIEGQLGENNELRLTRDALEPCTVGHRRYFIFGGGYVYFEEYAYSHQLSRADVTTVSTFIDLNITMLEDHEFVPLEVYTRHEIKDSGLLDYTEVQRRNQLHDLRFADIDTVIRADANAAMFAGLCAFFEGMGDLGRGGGGSGIVQQQNNLLRAIEAQQHLLQLTVWGIKQLQARILAGGSGGHTTWMEWDREINNYTSLIHSLIEESQNQQEKNEQELLE

SEQ ID NO: 168 - protein, 571 aa, Artificial Sequence
  Ectodomain of Measles F (1-488) - HIV GP160-based SSM
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGGRSGIVQQQNNLLRAIEAQQHLLQLTVWGIKQLQARILAGGSGGHTTWMEWDREINNYTSLIHSLIEESQNQQEKNEQELLE

SEQ ID NO: 169 - protein, 504 aa, Artificial Sequence
  Ectodomain of Lassa virus GPC (1-423) - HIV GP160-based SSM
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGSGIVQQQNNLLRAIEAQQHLLQLTVWGIKQLQARILAGGSGGHTTWMEWDREINNYTSLIHSLIEESQNQQEKNEQELLE

SEQ ID NO: 170 - protein, 583 aa, Artificial Sequence
  EBOV GP ectodomain, minus mucin like domain (1-311,462-650)- HIV GP160-based SSM + G2
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVGGNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQGGSGIVQQQNNLLRAIEAQQHLLQLTVWGIKQLQARILAGGSGGTTWMEWDREINNYTSLIHNLTEESQNQQEKNEQELLE

What is claimed is:

1. A chimeric polypeptide comprising an enveloped virus fusion ectodomain polypeptide and a heterologous, structure-stabilizing moiety comprising complementary first heptad repeat (HR1) and second heptad repeat (HR2) regions that associate with each other under conditions suitable for their association to form an anti-parallel, two-helix bundle, wherein the structure-stabilizing moiety is operably connected downstream of the ectodomain polypeptide.

2. The chimeric polypeptide of claim 1, wherein the HR1 and HR2 regions lack complementarity to the ectodomain polypeptide, so that they associate with each other rather than with structural elements of the ectodomain polypeptide, wherein association of the HR1 and HR2 regions results in formation of an anti-parallel, two-helix bundle.

3. The chimeric polypeptide of claim 1, wherein each of the HR1 and HR2 regions is independently characterized by a n-times repeated 7-residue pattern of amino acid types, represented as (a-b-c-d-e-f-g-)$_n$ or (d-e-f-g-a-b-c-)$_n$, wherein the pattern elements 'a' to 'g' denote heptad positions at which the amino acid types are located and n is a number equal to or greater than 2, and at least 50% of the heptad positions 'a' and 'd' are occupied by hydrophobic amino acid types and at least 50% of the heptad positions 'b', 'c', 'e', 'f' and 'g' are occupied by hydrophilic amino acid types, the resulting distribution between hydrophobic and hydrophilic amino acid types enabling the identification of the heptad repeat regions.

4. The chimeric polypeptide of claim 1, wherein one or both of the HR1 and HR2 regions comprises an endogenous Class I enveloped virus fusion protein heptad repeat region amino acid sequence.

5. The chimeric polypeptide of claim 4, wherein the HR1 and HR2 regions comprise complementary endogenous heptad repeat A (HRA) and heptad repeat B (HRB) regions, respectively, of one or more Class I enveloped virus fusion proteins.

6. The chimeric polypeptide of claim 1, wherein the HR1 and HR2 regions are independently selected from HRA and HRB regions of fusion proteins expressed by a virus, wherein the virus is an orthomyxovirus, paramyxovirus, retrovirus, coronavirus, filovirus or arenavirus.

7. The chimeric polypeptide of claim 1, wherein the structure-stabilizing moiety comprises an immune-silencing moiety that inhibits elicitation of an immune response to the structure-stabilizing moiety.

8. The chimeric polypeptide of claim 7, wherein immune-silencing moiety is a glycosylation site that is recognized and glycosylated by a glycosylation enzyme.

9. The chimeric polypeptide of claim 1, wherein the structure-stabilizing moiety comprises one or more unnatural amino acids.

10. The chimeric polypeptide of claim 9, wherein the one or more unnatural amino acids permit coupling of a polyethylene glycol, an immune stimulating moiety, or a lipid.

11. The chimeric polypeptide of claim 1, wherein the ectodomain polypeptide corresponds to a Class I enveloped virus fusion protein ectodomain.

12. The chimeric polypeptide of claim 11, wherein the Class I fusion protein ectodomain is from an orthomyxovirus, paramyxovirus, retrovirus, coronavirus, filovirus, or arenavirus.

13. The chimeric polypeptide of claim 1, wherein the ectodomain polypeptide corresponds to a Class III enveloped virus fusion protein ectodomain.

14. The chimeric polypeptide of claim 13, wherein the Class III fusion protein ectodomain is from a rhabdovirus or herpesvirus.

15. The chimeric polypeptide of claim 1, wherein the ectodomain polypeptide comprises a whole precursor ectodomain polypeptide or a portion thereof.

16. The chimeric polypeptide of claim 15, wherein the ectodomain polypeptide or portion lacks any one or more of an endogenous signal peptide, a protease cleavage site, an endogenous head portion of an ectodomain, an endogenous stem portion of an ectodomain, an endogenous mucin-like domain, an endogenous membrane proximal external region, or an endogenous fusion peptide.

17. The chimeric polypeptide of claim 15, wherein one or more endogenous proteolytic cleavage sites of a wild-type or non-wild-type fusion protein are altered or deleted to render the ectodomain polypeptide less susceptible to proteolytic cleavage by a protease.

18. The chimeric polypeptide of claim 1, wherein the ectodomain polypeptide comprises at least one pre-fusion epitope that is not present in the post-fusion form of an enveloped virus fusion protein to which the ectodomain polypeptide corresponds.

19. The chimeric polypeptide of claim 1, wherein the HR1 and HR2 regions of the structure-stabilizing moiety are connected by a linker.

20. The chimeric polypeptide of claim 19, wherein the linker comprises at least one moiety, wherein the moiety is a purification moiety, an immune-modulating moiety, a cell-specific moiety, or a structural flexibility-conferring moiety.

21. A nucleic acid construct that comprises a coding sequence for a chimeric polypeptide according to claim 1, operably linked to a regulatory element that is operable in a host cell.

22. An isolated host cell that contains the nucleic acid construct of claim 21.

23. A method of producing a chimeric polypeptide complex, wherein the method comprises: combining chimeric polypeptides according to claim 1 under conditions suitable for the formation of a chimeric polypeptide complex, whereby a chimeric polypeptide complex is produced that comprises three chimeric polypeptide subunits and is characterized by a six-helix bundle formed by oligomerization of the two-helix bundles of the respective structure-forming moieties of the chimeric polypeptides.

24. A chimeric polypeptide complex that comprises three chimeric polypeptide subunits according to claim 1 and is characterized by a six-helix bundle formed by oligomerization of the two-helix bundles of the respective structure-forming moieties of the chimeric polypeptides.

25. The complex of claim 24, wherein the chimeric polypeptide subunits each comprise an enveloped virus fusion ectodomain polypeptide, and wherein the complex comprises at least one pre-fusion epitope of an enveloped virus fusion protein of interest, or complex thereof, which is not present on a post-fusion form of the enveloped virus fusion protein, or complex thereof.

26. A composition comprising a chimeric polypeptide according to claim 1 and a pharmaceutically acceptable carrier, diluent or adjuvant.

27. A method of identifying an agent that binds with a fusion protein of an enveloped virus, or complex of the fusion protein, wherein the method comprises:
contacting the candidate agent with the chimeric polypeptide of claim 1 or a chimeric polypeptide complex—that comprises three chimeric polypeptide subunits according to claim 1 and is characterized by a six-helix bundle formed by oligomerization of the two-helix bundles of the respective structure-forming moieties of the chimeric polypeptides, wherein the ectodomain polypeptide corresponds to the fusion protein of the enveloped virus, and detecting binding of the candidate agent to the chimeric polypeptide or chimeric polypeptide complex.

28. The method of claim 27, further comprising contacting the candidate agent with the fusion protein or complex of the fusion protein and detecting binding of the candidate agent to the fusion protein or the complex.

29. The method of claim 27, wherein the candidate agent binds specifically to the chimeric polypeptide or chimeric polypeptide complex, or wherein the candidate agent binds specifically to the fusion protein or complex of the fusion protein.

30. A method of producing an antigen-binding molecule that is immuno-interactive with a fusion protein of an enveloped virus, or complex of the fusion protein, wherein the method comprises: (1) immunizing an animal with the chimeric polypeptide of claim 1, or a chimeric polypeptide complex that comprises three chimeric polypeptide subunits according to claim 1 and is characterized by a six-helix bundle formed by oligomerization of the two-helix bundles of the respective structure-forming moieties of the chimeric polypeptides, wherein the ectodomain polypeptide corresponds to the fusion protein of the enveloped virus; (2) identifying and/or isolating a B cell from the animal, which is immuno-interactive with the fusion protein or complex thereof; and (3) producing the antigen-binding molecule expressed by that B cell.

31. A method of eliciting an immune response to a fusion protein of an enveloped virus, or complex of the fusion protein, in a subject, wherein the method comprises administering to the subject the chimeric polypeptide of claim 1, or a chimeric polypeptide complex that comprises three chimeric polypeptide subunits according to claim 1 and is characterized by a six-helix bundle formed by oligomerization of the two-helix bundles of the respective structure-forming moieties of the chimeric polypeptides, wherein an ectodomain polypeptide subunit of the chimeric polypeptide or chimeric polypeptide complex corresponds to the fusion protein of the enveloped virus.

32. A method of eliciting an immune response to a fusion protein of an enveloped virus, or complex of the fusion protein, in a subject, wherein the method comprises administering to the subject a DNA vaccine or viral vector/replicon capable of expressing the chimeric polypeptide of claim 1, or a chimeric polypeptide complex that comprises three chimeric polypeptide subunits according to claim 1 and is characterized by a six-helix bundle formed by oligomerization of the two-helix bundles of the respective structure-forming moieties of the chimeric polypeptides, wherein an ectodomain polypeptide subunit of the chimeric polypeptide or chimeric polypeptide complex corresponds to the fusion protein of the enveloped virus.

33. A method for treating an enveloped virus infection, or for reducing infection by an enveloped virus, in a subject, wherein the method comprises administering to the subject an effective amount of the chimeric polypeptide of claim 1, or a chimeric polypeptide complex that comprises three chimeric polypeptide subunits according to claim 1 and is characterized by a six-helix bundle formed by oligomerization of the two-helix bundles of the respective structure-forming moieties of the chimeric polypeptides, wherein an ectodomain polypeptide subunit of the chimeric polypeptide or chimeric polypeptide complex corresponds to the fusion protein of the enveloped virus.

\* \* \* \* \*